United States Patent 10,233,495 (METHODS AND COMPOSITIONS FOR SCREENING AND TREATING DEVELOPMENTAL DISORDERS) - sequence listing, part 137

SEQ ID NO: 662 - DNA, 311906 bp, Homo sapiens
gagaagggaaagaacatcaaagtaatcagcaaaaatgagaatcatgaggggggttggaggtttgatgaaatcctgaagaccagcgacgggatcatggtggctcatgatggtataggcattgacattcctgcagagaaggtcttccttgctcagaagatgatgattgggtgctgcaaccgagctgggaggcctgtcatctatgccactctgatgatggagagcataatcacgaagctccaccccacccagggtgagggcagtgatgtggccaatgcagtcctggacagagtggactgcatcatgctgtctggagaaacagtcaaaggggattatcctctggaggcagttcgcatgcagcacctgattgccggtgaagcagaggccaccttctaatacttgcagttatttgaggagccccgcctcctggcatgcattaccagttaccccacagaagtcaccgatgtgggcgtcgtggaagcctccttccagtgccgcagtggggccataatcgtcctcaccaagtctggcagttctggtgaccagataccgcccacgtacccccatcgttgctgtgacagggaatccccagacagttcgtcaggcccatctgtaccatagcgtctttcctgtgctgtgcaaggatgcagtcccggaggcctgggctgagaatgtggaccaccgggtgaacttggctatgaatgttggcaaggccggaggtttcttcaagaaggaagatgtggtcattgtgctgaccaggtggtgccctgcctgcagcttccccaacaccatgcgtgttgtttccatgccgtgatggacccagagcccctcctccagcctctgtccctcctggttcccccaacccatccattaggccagcaacacttttagagctcactgtgggctgtaatgtggcactggtgggctgggtcaccagggaagaagattaatgccttgctgaaacatggctggttttagaatctgctcttgggtgggacagcccagagcctggctgcccatcatgtggccttacccaagcaagggaagaaggaggaatgcaggactggaggtccctggagtctatggcaaaagggtgacagcttcctttcctttctgtgctctgttcagttcctttattaaatggatgcccagaggactcccaaccctgtcccagggtcaggaaacagccagcaagagttaggggccttagggcatgaggcagtggtttcagtttaagcagactctggccctggcccatacttgctttcccaaccttctggacctcccctatttgcacctgtccccaccctccactcagctttcctgcagcaaacactatacccttctccttccatttctccccactgctgcagccacctccaggcccgttgttatagagcctacctgtatgtcaataaacaacagctgaagcacacacacacacaaaggctggaaggcagagattacaattaaaaatctaatctgaaactgcctggtgcaagagtatggcagattaatcacgaaaaaaattgacaaaaggaccagggtcgtttgattcaacccttggctgggttttgcacaaagtcttttgcacaagaaagggtacaattaccttggggtgaggaaaagaagtttttcaaactataacataaaaatataagggtttattggattatgaaagttagtatctttgaacacactttatatgaaataattgcatctctttcaactgatggtattatggtaatgaacattgtagattattagggaatgtttcttctacctgctactgtaaaacagaaggcatttaaattcgcccttcaatcaacattatttggacatgccaagtgagaatctgtatgattgcccaagttcacacagtgcagagtagaagccaaagtgctggctggtaatgacaaattatttacttattccacttgaggggcatttactgccttagctaaagctacccctatgacacctgaaatccccatgctgtatcaggtgatgtcagatatatattctaatggggaaggcagtgtccagaagaggtttataataaaatgaaaatggattatagaggatcatgctacctggagaatgcaaggaggagatactctcaagcagggatttttttcttccatagttcacttgtaactgcatgaaaaactgttggattctacagtgcctgataaatagctctcaactgaccaaccaagagctacttggttcacggatggcaattccaaggtaaatggacaccatcctctttagaaggctgttactttagaccaaagaaggtaaaaacaggcctgctctatgagctgaattgcatgctgtttttttaacagtgatggaaaaattaaacaatggtacaagcccctgtgttaagtttttactagcccacgggctgtgaccaatagcctgactatatgctcagatatcagggcaatgggagcctggcctgttaaaagaatgcccatatggagcttggctccatggagatttgaggggtgcattaaagtagaacaagtcaatggccatcagaactctcttccaggttcagaaagtgactgaaattgacaagcagatatccccatgtgttctgttgaggtggtcatctgggtccatcagataagtggatatggaggtattgtagcagtgcagagacatgctgaatctagacatgttccttttgcaccctctcaggcacaaaatcccagaaaaactcttccatttctcagcaagagagacagagactgctgattactaccgggcggatttctctggtgggaaggccctgaacataactggcaagtgagactgatgcttatagccctgaagggctgaaagtgggtcttgacaggaatagacaataactctggagtaggcttttgttgtccaatgaacaatgaaaatgctcagagtgccaaaaaaaaaaaaaaaaacagagaacattgcatggatttggatggctgaccatcatttttttcagaccaaagagcacactgcacagtccacaaattccaacaacaggcagagagatatcctccttagagtaataatttgatggagaagtagaacaggcaattggtttcaattggttgtctaagacaggggaagataaaggaataaagagctggcttgcacgccttcattagtgtgtgctcacactcaacatgaatgggaatgtagtgcccctgttagacttttctgttttattttgttttgttttgtttctggttgatctgggggaagagataatggggaagatgcatgtataatcatgcagttctcaccaagggaggagtacattggtattaacactgtgtatttttttctttcttcccaaattatctcaaaaaatgatttttctcttccttacctgatgcagtgatcttaggaccaggactgcaagaacaagtgctgcaacagcagggatgatttctaaacagaaaactgtaactatatttttaaactttatgtcaaaattcctaaaagcacgatggtggttggttgtgtcttcaccacatctagcaaaattgaggctaacagtgagtgcagctatgttgcctggtggtaaaaatagctcactaattctgcaccctaccctgtctgaacgggagtgaactggatttgtattgctacctgcaatgtagacaagcacagtggtgattctagtgccacttccaaaagtgaaaaagtgtcagtgttaatgaagagaaggggaaatagtagctgagagtaaaaaatgaataaatgggttcttcactgaggaaaatttaatattacattaaaaactcaaaagagtctcagagtaagagataacattgtctcagcataattatcccagatgcctgaaagggtaaagttgtatacttaccaaggtcattcctgcttttggaacctgacaagattgagaggatgcctgcatacttaagtgacctcatcttgggagatattcatacactatgatggactggattaattgttattgattgattgtgatatatatatatatatatatatatatatatatatatatatatatatttgatgtaaaggttccatggtaaaaaaccaggaggtggccctttggtgttatggtatacattggtttttgtccatggttacggactcataactcccacagcccttgttaccatcttttattataatactgggtatgttagaactcaggggcagggccaggtgcagtggctcaggcctgtaatccccgcaatttgggtggccaaaatgggcagatgacttgaggtcagatgttcaagaccagcctggccaaaatagtgaaacctcatctctactaaaaatacaaaaattagcggggcctggtggcatgcacctgtaatcccagctacctgggtggctgagacagaagaattgcttgaacccgggaagcaaaggttgcagtgagctgagattgcaccactgcactccagcatgggtgacagagaaagacttcatctcagaaacaaaacaaagcaaataactcaggggcaggcctctgacctcctgcccttctttcactctaatgtttctctgcctttctgaatgtggatcttaagacccttccatgagaggatctcaccctataccctggaggaagaaatcctgttgtcatgaagcttccataaaaccccaagggggcagacagggttaagggagcttccagataggtgaacacgtggaggtccctggaggctgatgcacccagagaagacatgggaactctatgcctcttcccttatgcctcactctatgcatcttttcatctagtctagcaagtagtctagtcgagcaggtaggtcctcctcagtttactcccattcagacggggtaaggtgcagaattagtgatttatttttaccatcaggcaatatagctgcattcagtgttagcctcaatttttctagatgtggtaaaggcacaacccaccaccgtcatgcctttaggacgtttgacataaagcttaaaagttgtatcctttgcaatattatttataataaaccaataaacataggtaagtgtttccctgagttctgtgagctgctcctgcaaattaatcaaccccaaagaaggagtcatggggattctaatttgaagccatttggtcagaagctctggggacccagacttgcaactggtgtgtggagaggagcagtcttgggaattgaggcctctactgtgggatctgacactctcttcaggcaggtagtgatagaaatgaattagaggacaaccagctgatgtctgctggtgtggggaaaaaccccacacagttggtcacagaagccttcttctgtgtttattattgttgtggtgtgaaaatagaggaaaacatggtttgggagtgttctccctacacggaaggtaggaaagaaagtatttgatcactgataccaaccacacctcctcatccttcagcagtggctgcatggaacagagaagtaatctgtatgctgaagagagagagagcacagaaatagtgagagatcacattgaactcagcactgccctgtcacagggaaaagcaaaattgggctgaactcagctgacccttgcccatgtaggaaatattcaaaccagcactagccagatgggatcactcatctcagctgtcaccaccaaggactaaagggttttggggctctgagtaaacaggacaggcagtctaggacacaagactgcaattcctaggtaagtcttagtgcagaactgggctcagagtcacatacttgggcagggtatgcagtctcctgagacacaagccagggcagctaacagagtgcttgaaccacccatcccaaccctaggcagcatacttcatggctgcaaaagagaccattactgtctgcatgaggatagtagaggggagagtgaagaggactttgtcttgcatcttagatatcagctcatccacagtaggatagggcattagtcagagtcatgaggcccttttcaggacctagcttctagatgacatttctggacacaccctgggaattaagggaatccactgccttgaggggaagaatgcagtcctgtcaggacccatcacctgctgactaaagagccctcaggccttgaataaccagcactgatatccaggtagtacaccatgggccttggctgatactctgagatgtgctggcttcagtaggggctaagcacatttccagctgtggtggctatgaggaaaggctccttctgcttgataaaagaggagggaaatgtaaaagggacttcatctagcaccttaggtacaagcgcagtgacaggagggtagagcatcaagtgggctgttggagtccctgattccaagtcttgttccagagccaagcatttctggatttgccctgggccagatgagagccaatcactctgaaaagtgaatcccaggcaagacagcattcaccaaaagctagtgaaagagcccttcggccttaagtgagctttggtggtatagcctgacagtactcatgattctttggtgatggtggccatgggttgagacttccctgcctgtggaaagggagggaagagtgaggactgtgtcttgtggtttgagtgccagtttagctttggtaaaatagaacaccaggtagacttctaaggtatttgactccattccatagctcctaaagagcatatttagatccactaagggcctgggaaatcttgccatacttaggggaaggacatgagcttggcttcctttaccacctgctgattgtagaaccccaacgcattgagtgaagataggcagtatccatggagtggttacagtgggtctggagtaaaacccagggctctgctggcttcaggtctgacccagtgcaatcctagaggtgctggaaattgggctgcttatgtcacaccaccaccacctctaggtggctcaaaaaagagagaaaggctctgtttgtttgggagaaagtaagggaagaaagcagagtctctgcctgataatccagaaaattctttttgatcttatccaaaaccatcacagtggtacctctgtgattctacaagaaccacagcattactgggcttgtggtgaccccctaatgcagatatggcttagatcacaatacccaattccttttaaatatctgaaaagccctcccatgaagaacaggtacaataaagttcagactgcaaagactacagtaagtacataaaatcagaaattctggagttgaaaaatgatgcactgaagaatgcatcagagtctcctaatagcagaattgaccaatcagaagaaagaatcggtggtcctgaagacagactatttggaaatgcacagtcagaggagacaaaaaagaaaggagtataaaaaaataaagcatgcctacagaatttaaaagtagcctcaaaaggccaaatctaagagttttgggtcttaaagaggagctaaagaaaaaaatagaaatagaaagtttattcaaaagaaaaacaatagaaaactttccaaacctaaggaaagataccaatattcaagttcaagaaggtcatagaagaccaagcagacataaaccaaagaagacaatctcaagccatattaaaaccaaactcacaaaggtcaaagataaagaaaagatactaaaagcaacaagagaaaaacaaaaacaaataacatacaatggagctctgcaacatttctggtagtgggcttttcactggaaaccttgcaggccagaagacagtggcataacatatttaaaatgctgaaggaaataaaactttgaccctagaagagtataagcagtagaaatattcttcaaatacagaagacaaataaagactttctcagacaaaaaaaaaaaaacttatgggtttcatcaacacaatatcaatcctacaagaaatgctataggcagtatttcagtcagaaaaaaatgatgttaatgagcaataagaaatcatctgaaggtacaaaactctctggtaatagtaagtaaacagaaaaacacagaatattataatactattactgtggtgtgtaaactacacttaagtagaaagactagaaggtgatccaataaaataataattacaagaattgttcaagatatagacagtacaataagataaaaatgaaaacaacaataaataaaaaatcagagaaacaatgttatggtgtagagttactattggtattgtttttgcttgtttatttgatcatttatttagtgttaagatgtgatcagcaaaaaaagttataaaatagtatttgcaagcctcatggtaagctcaaataaaaaacatgtaaaaatacacaaaaaatggaaaggaagtaactaatttctatcaccagaatatcaccttgactaaaaaaaaagacaagaaagaaggaaggcatgaaaagcagaccagaaaacaaatagcaatgtagcaggagcaagtccttatttattcataatagcattcaatgtaaatggactaagttttgcaatcaaaggcacagagtagttgaatgaattaaaaaaataaaacccagtgatctgttgcctataagaaacatacctcatctataaagacacacagagattggaaataaaaggatgaaaaactatatttattgccaatggaaagcaaaaaaaaatcaggagtagctgtacttatatgagtctaaatgaatttcaagataaaacctgtaagaagagaaaaagaagttcactgtataatgatacaaaggtcaattcatcaagaagatataaagacttaaatccatgacctcaaaatgtgaaactactacaacattggggaaaatctccaggacattattccgggccaaattttttgagcaatcccccataagcacaggcaaccaaagcaaaaatggaaaaatgggatcacatcaagttaaaaagattctgtgcagcaaagaacacaatcaacaaaatgagaagtcaatgcatagggtgggagaaaatatttgcagactccccatctgacaagggattactaaccagaatatataagtagctcaaacaactctataggaaaaaatctaataacatggttaaaaatgggtcaaatatctgaatagacatttctcaaaagaagacatacatgtgacaaacaggtatataaaatggtgcttaatatcattgatcatcagagaaaaacaaatcaaaactacaatgagatatcatctcaccctagttaaaatgtgttttttttccaaaaacacacaataaaaaatgccagcgaggatatgaagaaaagggaaccctcatacactgttggtgggaaagtcagttaatataactgttgtggagaaaagtttgaaggcaattcataaaaaattaatattagagttatcatatgatccagtaatctcactgctgggtatatacctgaaagaagggaaatcagtgtatcaaggatatatctgcactcccacgtttgttgcagcactcttcacaatagccaaagtttggaagcaaccaacacacatatggataaaaaatgtgctacatatacacaatggagtactactcagccattaaaaaaatgacagacattctgtcatttgctaagacctggatggaactggaggtcattacattaagtgaaataatccaggcacataaagacaaactttacatattctcacttttgtgggaactaaaaattaaaacaattgaactcacagacatagcagaatgtaatgggcatagtgcttgatagttttctcatctgatcctcctctcaccctcttttttcaagtatgtctgttgtttctttctttatggccatgtgtactcgatgtttagtttccacttacacaagaaaatgagatgtttggttttctttttctgtgttaattcacttaggataattgcttccaattgcatccctgttgctgcaaaggacatgattttgttctttttttggctgcatagtattccgtggtgtatacagaccatattttctttatacagtccaacactgatgtacatttaaggggattctatgtcattgctattgtgaatagtgctgtgatgaacatatgaatacatgtatctttatgatagaacaatttatattcttttggatatagacttattaatgggacgactgggtttacaggtagttctaagttatttgagaaaagtccaaactgctttctgcagtggctgaattaatatatatatttccaacagcaatgtacaaatgttcccttttcttcacaacctcaccagcatctgttactttttgactttttaataatagccattctgcctgttgtgagatgatacatcattgtggttttgatttgcatttatataatgataggtgctgctgaacatttgttcatatgattgttggctgcatttatgtcttcttttgagaagtgtctgttcatgttctttgcccatttttgaatggggttgtttgtattttgctttttaagttctatatagactctggatagtagacctttttttagatgcatagtttgaaaatattttttcccactctgtagggtggtggcttactctgttgatgatttcttttgctgtgcagtagctctttaatataattagatcacatttctcatttgtttcataaattttcttattattttcatgggcacattgtaggtgtatatatttatagggcacatgagttgttttgatacaggcatgcaaggtagaataagcacatcatggataatggggcatccatcctgtcagtcatttatcctttgtgttacaaacaacataattacattatttttattatttaaaatgtacaattaagttactatttactatagtcgccctgctgtgctatcaaatagtaggtccttttttattccttctaactatattttgtacccattaaccatctctacctctcccaaagctcctaacccccactacactccccagcttctagtaatcatccttctactctctatgtccatgaattcaattattttgatatttagatttcacaaataagtgagaacatgtgatgtttgtctttctgtgcctggtttatttcatgtaacataaaaatctccagttccatccatatagttgcaaatgacagaatctcattcttttttatggctgagtagtagtccattgtgtatacctaccacattttttatccattcatctgttgataggcacttagattgcttccaaatcttagctattgtgaacagtgctgcaacaaacatgtgagtgcagatatcccttcgctatactgactttcattcttttgggtatataaccagaagtgggattgctggatcacattcaactgttgggtttctttcagttgtttttccagttttcatcataaaaactttgcagggcctatgtccagaatggtatttcctaggttatcttccacagtttttattgctttaggttttgcatttaagtctttaatttatcttgagttgatttttttatatgctgcaacaaaggggtccaccttcaatcttctgcatatgactagctagttatcctagcactgtttgttaaatacagagttcttttcccattgcttcttattattgattttgtcaaagatcagatggctgtaggtatgtggctttatttctgggttacccaacctgttccactggtttatgtgtgtgtttattagtaccatgctgtttcagttactgttgatttgtagtatagtttgaagatgggtagtgtggtttctctagctttgctgttttttccttaggattgctctggctatttgggctgtcttcctcttccacatgaattttagaatagtatttttctaattctgtaataaatttcgttggtaattagatagggacattattgagactgcaacttattttatgcagtaaggccattttaataatgttgattcttcctatcaatgtgcatagaatgtttatccatttctttatgtcctctctgatttttttagcagtgttttacaattttcattgtagagatctttttatctctctggttatctctattcccttgtattttattttttgaggctattgtgagtgggattgtgttcttcatttagttctcagcttgtatgttattggtatgtagaaatcttactgatttttttacatggatttcatatcataaaacttttctgaagatgtttattagatctagaagccctggacagaaactatggggtttttgaggtatagatttatatgatctgtgaagagatagtttgacttctctttctatttggatgtctattatttatttttcttttctgatttctttagctagtacacctagtaccaagttgaatagcagtgatgagggtgaaactccttcccttgttctttttctcaagggcaatgcttccagcttctgtcatttcattatgatgttggctgtcagtttgtcaaataggaatcttaatattttgaagtatcttcctttgatatctagtttgttgaaggtttttaacataaaaggatgttgaattttatcaacagccttttctatgtctattgagatgattgtgtggttttgcttttagttctatttatgcaacaattcacattaattgatttgcatatgttaaaccaactttgcattgcagaaataaagactatttagggtgctggattagtgttttgatgtgctgctggattaagtttgctagtattttgttgagaatttttgcatctatgttcatcaaggatattgacctgaagtttcctttcttgttccagctctgtcatattttggtatcagtatgatgctggcttcatagagtgagggagaaagaaattcctccttcttgattttttgtaaaactttgaataagattggtaatatttcttttgtattcttctggaagaattaggctgtgaatctctctgatccagaattttttcaagttggtaggtttttcattattgattcaattttggaactcataattgatctgatcagggttttaatttctttctggttaaatcttgggaggtttagcattaccaagagtgtatccattgttcatagtagtcactgagtttttttttttttttttttgtatttctgtgggttggtggtaatgttccctttgtcatttctgattctgcttatttgaatcttctctcttttaatttattagtctagctagtgatataccaatgttatttgttctttctaaaaaccagctcctggattcattgatcttttgtgtagtttttgcatctcagtttcattctatttaaatctgatttcggttattttgtttttctgctactagctttggagtagatttgctcttgttttttctatttcttctatgtgtgatgttagattgttaacaatatttttctaactttttaatgtgggtgtttagcaccataaacttcttcttaacatgctttagctctgcccaacaagttcttttttgctatatctttgttctcatgagttaaactaattcttacttgctgccttaatttcattttttacccaaaaaccattcagtagcagattgcttaatttccgtgtaattttatggttttgagagatttcttggtattgagttgtgtttttattgctgtgtgggccaagattgtggttgaaaaattaaaaaaaaattctttgagcattgctctattactgagtgtgtggttaactttaaaacatgtgtcatgtgcagatgagaagaatgtatactctgttgttgttgggtggaatatactatagttatctgttaggtccatttattgaaatgttaagtttgcatcctgagtatctttgttagctttctgcctccatgatctgtctagtactgtcagtatagtgtcattatctaagtttcttcatagctctctaactacttgttttatgaatatggatgctccagtgttgggtgcacatacatttaagatagttaattcttgttgaattcaactctttatcattatgtaatatctttcattgtcctgttttgattgttgttgctttggagtctgttttgtctgaaataagaataacaatccctgctctttttgttttttatttgcttgatagatctttccctattcctttactttgatcctatgattttccttgagtgtgtgatgagtctcttgaagagagcatagagttggttctcgcttctttatccaacatgccactctatgacttttaggtgggtaatttagtccattttcatttaaggttaatattaatatatgtgaatttgattctttcattatgttgttagctagttgttatgtacacttgattgtgtagttgctttacagtgtcaattgtctatgtatttaagtatgtttttgttgtggccactcataatctttcattttcatgtttaattctcccttaagaacctcttgtaaggcatatctggtggtgataaattctcttagcatatgcttgtttcaaagagactttattttttctttgcttgtgaagcctagtttggatggatataaaattcttggttgaaatttttattctttaataatgttgaatataagcccctaacctcttctggcttctgaggtcctgccagaaattccactgttagcctgatagggttccctttgtctgtgacctaccccttttctctcgctgccttaaatatattttttcttttctattgatcttggataatctgatgactatgtgtctttgaatgtcatcttgcatagtatcttgcaggggttctctgaatttcccgaattttaatgtggacctttctaatggttggaaaaatcttcatggacaatactctcaaatatattttccaagttgcttgctatctctccctgtctttcagggataccaatgaatcctaggtttcatctttttacataatcccatatttttcagatgttttgttccttctgttttattttttctgactgagttgaatcgacgaaagcagtctttgagctctgagggtctttcctcagtttggttgattcaaccattaatacttctgattgtatgaggaaattcttgtagtgagtttttcagctctgtcagatcactttggttctttcttaacatggttattgcacctttcagcttttgaataattttactggatttcttaagattacttggattcagtttcacctttctcctgaattttgatgatctctgttgccatatggaatcatatttatgtaatttttcagccatttaagtctggttaaaaaccattgctcgtgagctagtgtaatcatttgaaggtgagaagccattcatttttcagacgtcaaatttcttacactagtttttttctcatctgtctttgtgagcttatttccctttattgaactcagaattctttagatgggacttattgcttttttattcttggaggttcttgaggatttcactgtggtataagttgggtttagtcaactagctttgtctttggatgatttcagggggccaaggctcagctcagcactcctggctacatgctcttaccctgtgggtcttggaccatgcctacagctttggtctctggcctcttgagtttaagcaccttctatgctggaggtcccaagttgttcttagttcactggcaacaatactccagtggggagtgctagcaaaagtctttcactggagtgttggaagcagagtccgtattcatgcatgcatctgcagtagaggagcagttatgcagcaatgtttgtgtgtgtgctgttagtgttggggcagcaaaatccatgtacacatgtgtgccagtgaagaagtgtgtggaggctgcaggtgagtacatgacatcaaagtagtgataggagactgcaggcaggtgtgtgctagtgggatcccatctgcaaatgctctctgacagtttgggagggactgccagcataaaaactatggccatggctactgggaagtgcctcagttgtgcatctgaggctgagctgcaagagggtgtagcccgtcaaggaccctggaagagtttggcatgttgggggacaggggggcactcagatcaaactggaaagctggctttgttctaagcaagtctcacagtcaacaaaagccaaagccatctagaggagcatggtgggccttggcggatgtgtttccttggtcatgctccactgcagtcattcccacaccaaatcctccagactccatgcacactggagccctgtacttggcaatttcaaatgtccttggggatcactgagtcgcctgcagctaggattccagagatccatgatgagagtcagccactgcatgcctatttaactcactcattccccacgaactactcagggccaggagtgagtcgtgttgattgacagtcctctgcagggtcttcagcattgtccccctttcgcccagaggctgcatcctccctctgtccactctcaatgcctttcttccaaaaatctgcttggagtgtgtgggccatcctgatggtctggtctctcagtgggagaagctcttcctggctgcatctagtcaaccatcttctctctgtttgtaacaaacctgcatatgtactcctgaagttaaaataaaagttaaaaaagagaaaaaattacttcaaaggcgtgagaaataaagagccttgacaaaaacaaatgagaaagggacaatagggaggtatttggggtgggaggtggcctggggtaacatgagataagagagagggagaacacattctgctgtctgagatgttgatgggaaggctttcactctatattggctgatgtatcacagtgatcaggagggaatagcatgcagagaagacaggcctgttcatcactgtcaagttacagtttgaaaactaacgctgatagctttcagagtgtgctgtgagggtaaatttcagcaggactaaaattagcctgagctgctttctaaagttcttacatgtcactaatgcctggtcaatgaatgaatcatacagattaagagtgttgatttggtccaagaattatcgagatggtttgcaccagcatgtcagcattgtttacttagtgcgagatttatgattacacactttgggagtgtgctggtctcagtgtatatctttgcttctaatacacaaatgaatactttatttgtaccattttacacaaattagtcattctttcattgatatctcaaccatcacagtttcaattttcttatacgtgctagttaatgcttttagaaataaaacagaaagtcaattaaaattagtctttctttagataatatccaataacccaaattcccctttgaccacccattcttcttttaaaaaaataaaaacacttagtactgctgatatggcttagacatttgtcccattcaaatctcatgttgaattgtaattcctaatgttggcagtgaagtctagttgagaagtgtttgggtcatcgggatgaatccttcatgaactgcttggtgacatcctcatggtaatgagtgaggtgccactcttagttccacaagatctgatttttagaaaggtcatggcacctcctcccttctctgtctgttcttctctcttccactatatgatatctacatgccagcactcctttgccttttgccatgaatgggagcagcctgaatccctcgtcagaagatgttgacaccatgattcttgtacaacctgaatatccatgagccaagtaaacctcttttctttataaattacccatcctttgatatttatttataacaacacaaatggactaagacacccaccctcttagttactaaagggcattaattcagcaattatttcctgtctttcatatattggcaatgttgtcttctttactggatcattctcatcagtatatgacagaatctcccatcttaaaaaatagtaagtagttgagtgataaatagattataaatagatagatgaacagactgatgattcacagatagatatatagtataactcaatcttatggctttaaatgcgtttacaactttcacattttatgtccagcctggaactttcctatgaactctgtgctcatatctaactgcatacttaacatctcccactggatgtctgatagacatcttaagcttaccatgtcaaaggacaaagacctagtcttcttcaagcccccttccaaaaaattccttggtatttagttttcctaattgcatttaatggcaattctagccatctagttgcttgggcaagaaaccttagattcatctttaactattgtatttctttcacttcctacatccaatccattaacaaatcaacaattctgtgatctctcctttcaaaatatgtttcaaatctcataatttccctttaccttcactactatcactctgctctaagatttcatagtctttcttgggactgttgcaataaccactttactgatctcctcacttttacacttgcctgaaatacttttcctccaaattttcacagtctcattctctcattttcttccttctatgcttaacattgcctcctaagagagggtttccataacaactcaattttaaaatgtatcttccagccactctctattttcttacccaacactgtttctccataaaatgtaacatcacctggcatagaccataagatctacgatggcagaaacttcgttttgttgaaaggaagaggcactgtaacattgaagcagaaagttttagtgctagaacaagaagaatttggatattgctgaggcctaggatctgtggcacagagtaatagctgaagctagaaatgttttggctgtgcctaattttgaagggttataaggcctggacaagtaatttgggctttattctttagaaaattaggtattgccttccaataggcctgaaatatcttatcagctgaggaaagtcaagggtgggttctgtaccttaattagtcatgattatctattcactgtgccacagaggaagctctgaacattttacaggattttctggtttcttcaggcaactgctaagccccagaatggtttcgcaaattgcctgttttcactttgcaactcctgtgagccataaccctgaggtaccagggctctggtgagatggtatagtatacgaagaagagcatggttattgaagcgagacagccctgcatacaaatcccagttgtgcagttcactagctataacttagacaaattacctaggtagtcaaaattttattatttatatttataaattgagagtcagtagactatttaaaaattataatgggcacaaaacacccagaagaatgacttgaacgtaatagttccctgacaccagaccccagtctagtctttgagaagagaacctatttcatttttctcacctgctccttctcacttccttgccctgtgtactaatagttaaacaggtttctattactaaagaagatccacagtatccaacatagaaatgtctacaaatatacagttttactagaaaaaggtacaatacagtaacggcattaaaatgggatatgcatcagaatcaaaagctgttttacagaaatgagtctgttttatgggcttctattgtcctccttctttacgagtcatgacctaatacattttctcacatcacgaaccactgacgattgaaagaaacagggattccaaaatgactgaaatttttaaatattttactggtcaaacagacatattactgctacgtaactggtcccaaaagcagagttattctggagtctcagcaagatcaggtgtaaatcataaatcttgcacttaataaacaatgctgacatgctggtgcaaaccatgtcgataattcttggaccaaatcaacactcttaatcagtatgtttcgttcattgaccaggcgttagtgccatgtaggaaatttaggaagcagctcaggctaattccagtcctgctgaaatttaccctcacagcacactctgaaagctatcagcattagttttcaaactgtaacttgacagtgataaacaggccagtcttctctgcatgctattccctcctgatcaatgtgattcatcagccaatcttctgagcatggggagtgaaaagccttcccatcaaacaactcagacagcacgtgttctcccgctctcttatcccatcctcccaacccaaatacctccctattatccctttctcatttgtttttgtcaaggctttttatttcccatgcctttgaagtaatttttccctcttttttaactttcattttaacttcaggggtacatgtgcaggtttgttgaataggtaaatgtgtgtcataggggtttgttgtacgaattatttcatcaaccaggtgctaagcctagtattcattagttacttttcatgattctctccctcctcccaccttccaatagtctccagtttgttgttccccactttatctccatgctttctcaccatttagctcccacttagaagtgagaatgtgtggcattttttctattcctgcattagtttactaaagataatggtctccaactccatccaagttcctgcaaaggacataatctcattctgtattatggctgcatagtattccatggtgtatatgtaccaaattttctttatccagtctaccattgatggacatttaggttgattccatgtctttactattgtgaatagtgctgcaattaacatacacatgaatgtgtttgcataatagaatggccttatattcatttcggtatatacacagtaatgagattgcttggtcaaatggtattgctgactttaggtcatacagtgtataagcatttcttttttccacaaccccaccagcatctgttattttttggctttttaattaaagccattctgcctggtgtgagatggcatctcatttttttgatttgcatttctctaataatcagtgatgccatgcttttttttcatatgattgttggctgcaggtacgtcttcttttgaagtgtctgttcatgtcctttgcccactttttaatgtttttttttttttcttgtaaatgtgtttaagtttcttatagatgctggaaattgtgtctttgtcagattcatagtttgcaaagattttctcccattctgtaggttgactgtttactctgtggatagtttcctttgctgtgaggaagctttttagtttaacaatatgccatttttcagtttttgcttttgttgtgactgcttttggtgccttcatcatgaaatacttgcctattcttatgtcaagaatggtattgcctatgttgtcatccagggtttttataggattgggttttacatttaagtatttaatctaccatgagttatttttgtatatggcataaggaattggtctagtttcaatcttctgcatatgactagccagttatcacagcaccatttattgaacagggaattatttcctcattgcttctttttatcaggtttgttgaagatcagattgttgtaggtctgtggacttgtatctgggttatctattctgttccattcatctataactccatattctcttattttgcaaactttaacatttgttttcttggattcctgaaattaaatttaaaaggccagtttctaaaatcagtcaagactcgtcaatccatttgtattttgatgtacataacttaagttagaaacaaaaaaacaaaaatgccaacaaatgccaaagtgcttcaaagtgcaagccagttacaacttcaggtagtcattaaagtaaattaaatgcattgttttgaattttttaaaaattggctttgtaaatttttataaagtactccagaagtgaggctttcttatcaccttctaaataaacaaagtcttgaattccacagaccaaagagtaaaataaaaacaaaattaaaaattgaccatgcacacctgcctgcttagctataacatagtttattaatataatgatttagtacctaaagattaatgaggcattcaaggagattagtaaacccaaatttgcagcagtttgattttttaagattaagtcatgttctaaagaataaatactattctaaataatcataaaagtgatttcatagacatgttctttcactttaatagtataaattcaatttgcaccaagagtaattaagtaatgagttagtcacatcaatgagaggtaccatatgtctatgaatacaacttttaaaattaataaaatgagatcatcagaaatcaccaccctttgacattatatcttgacattcctggccagcctcccataagtgttatcaaaccacattgcaactcaatggcaagcaaaaaaggattgcagtaacccttgtgaggatgataaatatttaaatgcacgacctctgattctagtggaaatggagtgatggaaaatctacctgggcaatttgaggtcatcatatcagcaaagagtgggaaattctacatagcaaaatgtgagaatctaaatgcacaaagtataatgattgtgaataacaatatttaatttgctatgacaatttccattatttaacaaaatacactgttgacaactttgcattagaaaactcgaaagaataattcactcagaaaaaatctagtaaaataaactgtcaaccatataacaatagtacttttatttttttttttattttcataggattttgagggacaggtggtatttggttacatgaataagttctttagtgatgatttgtgagattttggcacacccatcactaaagtagtatacgctgcaccctatttgtagtcttttatttttcatccctttcccacccttccctgctgagtccctgaattccattgcattattcttatgcttttgcatcctcataacttagctcccttttatgagtgagaacataacaatgtttgtttttccattcctgagttacttcacttagaataatagtctccatcccatgcgggttgctgcaaatgtcattaattcattcctttttataactcagtagtattccatcatatatatatatatatatatatatatatatatatatatatatatatataatcagttctacatttttgtaattgcgaattgtgctgctataatcatgtgcgtgaagtatccttttggtataatgacttctttacctctgggtagataccaagtagtataattgctggatcaaatggtagttctgcttttacattttaaaggaatctccacaatgttttccatagtgtttatactagtttacattctgaccggcagtgtagaagtgttcacttttcaatgtatccacaccagcatctattattttttatttttttatattggccattcttgcaggagtaaggtggtatcacattgtagttttgatttacatttccctgatcattagtaatattgagctttttatcatgtttattggccatttgtgtatcttcttttgttaattgtctatttatatctttagctgagtttttaaaatgagatggtttgttttttcttgctaatttgagttccatgtagattctggagattagtcttttgttggatgcatagattgtgaagattttttgctattctgtgggttgtctgtttactatgctgactgttccttttgacatgcaaaagctctttagtttaattaagtcccacttatttttctttgtttttgttgcatttgcttttgagttcttcgtcatgaaatctttacctaagccactgtctagaagagtttttccaatgttaccttctagaatttttatagtttcaggtcttagatttaagtctttaatccatcttgagttgattgttgtataaggtaagagatgagcatccagtttcattctcctacatgtggttagccaattatcccagcatcattttttgaaaaagatgtcctttactcacactgtttttgtttgatttgtcaaagaccagttgtctgtaagtatttgggtttatttctgagttctctattctgttccattggtctatgtgcctatttttataccagtaacatgctgttttgatgactatggccttatggtatagtttggaatcaggtaatgtgatgccttcagatttgttctttttgcttagtcttgctttggctatgtgggctctttttgggttccatatgaatcttaggattgttttttctacttctgtgaagaagaatggtagtatgttgatgggaattgcattgaatttgtagattgcttttggcagtatggcctttttcacaatatggattctacccatccgtgagcacatgatgtgtttctatttgtttgtgtcatctatgatttctttcatcagttcctctacgaggaaaactacacctcctttgttaggtatattcctaagtatacacctttacttcttctttacctatttggatgccctttatttttttcttttgcctggtagctctgcctaggactgccagtaatttgttaaatagaagtagtgagagtgggtatccttgtcttgttccagttctcacagggaaagctttcaacttttctccattcagttttatgttggctgcagatttgtcatagatggattttattacattgaggcatgtttcttttatgccaattttgctgaggattttaattataaaggaaagttggattttgccaatatgaaggaaagttggatcatgtgatttttgtttctatttctgtttatgtggtgtatcacatttattgacttgcatatgttaaacaactcctgcatcgttgttataaaacccactttatcgtggtggattatcttcttgatatgttgttggattcagttggctagtacattgttaaggattttagcatctatgttcatctggactatttgtctgtagttttcttttttggttatgtcctttcctggttttggtactagggctattcatagaacaatttagggaggattccctttttctctgtctcatggaatagtgtcaataggattggtaccaatccttctttgaatctctggtagaattcagctgtgaatctgtctggtcctggactttttttgttggtattttcttttattacaatttcagtctcactgcttgttagtgggtgtgtttggggtttctaattctccctgatttaagctaggagggttgcatctttccaggaatttatccatctcctttagtttatgatcataaaggtgttcattgtagccttgaattatcttttgtatttctgagttgtcggttgtaatatctccagttttgtttctaattgagcttatttggatcttctatcttcttttcttggttaatcatagtttaaatctattgtctctttcttgactttctgtcttggtgacctgtctagttctgtcagtggagtattgaagtcccccactcttactgcattgctgtctatctcattccttaggtctcataggcattgtttcataaatttgagagctccaatgttaggtacatatatatttaggattgtgacatttcctgttggacaaggccttttatcattatataatgtccctctttgttttttttaactgctgttagtttaaagtctgttttgtctgttataagaatagctacctttgcccacttttcgtgtccatttgcatagaaggtctttttccacccctttaccttaagtttatgtgagtccttatgtgttaggtgattctcttgaaggcagcagatgcttgaatggtgaattcttatgcattttgcagttttgtgtctttttttattattatactttaagttttagggtacaagtgcacaacgtggaggttagttacatatgtatacatatgccatattggtgtgctgcactcattaacttgtcatttaacattgggtatatctcctaatgctatccctccctcctcccccaaccccacaacaagtcctggtgtgtgatgttccccttcctgtgtccatgtgttctcattgttcaattcccacctatgagtgagaacatgcggtgtttggttttttgtccttgtgatagtttgctgagaatgatggtttccagcttcatccatgtccctacaaaggacatgaacccatcctttttttattgctgcatagtattccatgttgcatatgtgccacattttcttaatccagtctatcattgttggacatttggcttggttccaagtctttgctattatgaatagtgccataaaaaacatacatgtgcatgtgtctttatagcagcaggatttataatcctttgggtatatacccagtaatgggattgcatcactggccatcagagaaatgcaagtcaaaaccacaatgagataccatctcacaccagttagaatggtgatcattaaatgtcaggcaacagcaggtgctggagaggatgtggagaaataggaacgtttttgcactattggtgggactgtaaactagttcaaccattgtggaagtcagtgtggtgattcctcagggatctagaactagaaataccatttgacccagttttgtgtcttttaagtggagcatttacattcaacgttagtatcgagatgtttggtatttcatttatcttgctatttgttgcctgtataccttggttttttaattgtattattgttttgtaggtactgtgagatttatgctttatggagattctgttttggtgtgtttccaggattcgttccaagatttagagctccttttagcagttcttctagtgctgacttggtagtggcgaattctcttagcatttgtttgtctgaaaaagatgatatctttcttgcatttatgaagcttagactcactggatacgaaaatcttggctgatcattgttttgtttaaggaggctaatgataggtccccaatttctcccagcttgtagggtttctgctgagaagtctgctgttaatctgataggttttcctttataggttatgtggtgcttttgccttacaactcttaaatttctttactttgtcttgactttatttatttattttattttttgtgacagggtctggctctatcacccaggctagagtgcagtggcttgatttcagctcacagtaacctctgcctcctgagttcaagtgattcttgtgccttagcctccctagcggctaggagtacaggcatgcaccaccatgcctagctaaataaaaaattattcaaactgaacaacaatagtgacataacctatcaaaacctctgggagacaacaaaggcggtgctaagagaaaagttcatagccctaaaagcccacatcaaaaagtccaaaagagcataaaccatctaaggtcacaccccaagtaactagataaacaagaacaaaccaaccccaaacagagcagtagaaagaaaataaccaagatcagagcagaactaaatgaaattgaaacaaagaaatacacaagataaatgaaacaaaaagcttgttctttgaaaacataatgaaaattgatagaccattaacaagataaaccaagaagagagaaattccaaataagctcaataagaaatgaaataggagatattacaactgacaccacagaaatacaaaagatcattcaagcctactatgaacacctttacatgcataaagtagaaaatctagaagagaagcttaaattcctggaaagataaaaccctcctagcttaaatcaggcaagaagaattagataccctgaacagaccaataataagcagcgatattgaaagagtaatttaataattaacaacaataaccacaagcccaggaacagatggattcacagcggaattctaccagacagacaaataagaaatagtatcaatcctattgacactattccacaacatacagaaatagggaaccctttctaaatcattctatgaagccagtatcaccctaataccaaatccaggaaaggataaaaccaaaaaagaaaactatggaccaatatcactgatgaacatagactacaattcttaacaagatactacctaagtgaatctaacaatatatagaaaagataatccaccatgatcaagtgggtttcataccaggaatgcaggaatggcttaacatatgcaagtcaataaacgtgatgcactaaataaatggaagagaaagcaaagatcacatgatcatctcaatacatgtacaaaaagcattagacaacatctagcattcctttatgattaaaactcggcaaaattggcatacaaggagcatacctcaatataataaaagccatttatgacaaacccagagccaacataatactgaatgaggaaaatttgaatgcatttcctctgagaactggaacaagacaaggatacccactctcaccactcctgctcagcatattactggaagtcctagccagaacaatcagacaagagaaagaaataaagggcatccaaatcagtaaagaggaggtcgaactgtcactgtttgctgatgatatgatcatttacctagaaaaccctaaagattcctccaaaaacctcctagaactgataaaaaattcagcaaaatttctcgatacaaaattaatgtacacaaattagtggctcttctatacaccaacagttactaagcttagaagcaaatcaagaactcaaccccttttacaatagctgcaacatatatagatagatagatatagatatagatatagatatagatacatacacatacatacatacttggggatatacctaacaaaggaagttaaagacatctacaaggaaaactacaaaacactgctgaaagtaatcatagatgacacaaacaaatggaaacacacctcatgctcatggatgcgtaaaatcaatattgtgaaaattattatactgctaaaagtaatctacaaattcaatccaattcccatcaacataccacccttactcttcacataatttgaaaaagcaattctaaaattaatatggaaccataaaagagcccacatagccaaagcaagactaagcaaaaagaactaatctgtagacatcacattgcctgattccaaacgatgctataaggacatagttaccaaaacaggatagtactgatataaaaataggcacatagaccaatagaacaaaatagagaacccagaaataaacccaaatacttacagccagctgatctttgacaaagcgaacaaaaacgtaaatggggaaaagacatccttttcaacaaatggtactgggataattggctaaccacatgtaggagaatgaaactgaatcctcatatctccccttatacaaaaatcaactcaagatgcattaaggacttgaatctaagacctgaaactaaaaattccagaagataacattggaaaaactcttctagacattggcttaggcaaggattttattaccaagaacccacaagcaaatgcaataaaacaaagataaatagctggcacttaattaaactaaagagattttatgggcaagaggaacagtcagcagggtaaacagacaacacacagaggaggaaaaaaggtcttcataatgtaaacatctgacacagaactaatatccagaatctaccacaaactcaaagaaatcaacaagaaaaaaaacaaccccattaaaaagtgggctaaggacatgaatagacaattctcaaaagaagatacacaaatggccaacaaacatatgaaaaaaagctcaacatcactagtgatcagggaaatgcaaatcaaaaccacaatatgataccatctttctcctgtaagaacgaccataatcaaaaaatttaaaaaaaaattagatgttggcgtggattcggtgaacaaggagaacttctacactgctggtgagaatgtgaactagtacaaccactaaggaaaacagttgatgattccttaaagaactaaaagtagaactaccatttgatccagcaatcccattacttggtaactacctagagaaaaataagtcattataccaaaaaaaaaaaaaaaaaatacttacacatgcatgtttatagcagcacaatttgcaactgcaaaaatgtggaaccaactcaacttcccaacaatcaacgagtggataaagaaactctgatatatatatacactagtattctacagtgtgtgtgtgtgtgtgtgtgtatgtgtatatatatacacactagtattccatagtgtgtgtgtatatatatatatacacacacacacatatatacacactctagtatttgatggtatatatatatatatatatatatatatatatatatatatatataccattgaatactagtcagtcataaaaaggaataaattaatagcattcacagtgacctggataagattgaaaattattattttaagtgaagtaacctcaagaatgaaaatccaaacatcgtatgtacttatgagtggagctaagctatgaggatgcaagggcataagaatgacacaatggattttggggactcagggggacagaaagggaagggagtgagagataaaagactacaaataggatgtagtgaataccccttgggtgataggttcaccaaaatctcacaaatatcaccactaaagaacttactcatgtaaccaaataatctgttccccaataatctatggaaataaaaaaaggatgccaagacagcaactatattacaacaatttatggtaccttcttttttaagctgatgacaacttaacatcaattgcatacaaaaattatacacttttaattctccttatatacatacattatgtgctattgatgacacattttatatccttttttactgtatacattaagaacttattgttgctatatttatttttaatgcttttgtctcttaaccttttattccagatttataagtgatttacacaccaccattacaatattagagttatctaaatttgagtatatatttgcctttaccagtgagttttacactttcatatgttttcatgttgttactttttatcttttcatttcaactcaacgaactccctttaacatttcttgtaaagcaggtctagttgtgatgagctctctcagcttttgttcttcgaatgtcttcatctctctttactttctgaaggactgccttcctgggtattgtatcctcggttgacagatttgtttcttttagtgctttaatatggcatccctctccctcctggcctgcagtttctgctaacttcacttatagccttctgggtgatttttttgtttgaaaaagtctgttttctcttgatgatttcaatattctctttttgccttttacttttgacaatttgattacaatacgtctccaggtattctttagtcttaaatgtgatcctttgagttttgtgaatctgcatgtccatgaatcctataatacttgggaagtttccaaccattatctatttaaataagctttatctcccttttattcaccttttacctcctgggcctcccatatttcatttattcattcctttgatggtgtccaatggtgtccaataggccactcatgtttacttcaacttttttattcattttttttgttattctaattggctaatttacatggcatatatttgagtttattgattatttattctccataatcaagtctgctgtttatgctttctattgaatttttcagtattgctattgtattcctcagctgtgagagttctggttggtaattttctatgatttctacttcttcattctacttataatttttgtcatgccttgtgttcctgactttttctttgtctatttgtgttcttttgcatctcatcaaacttttaaaaaatagctattttgaaattttttaggcaatttgtagatctttattacttagagagttattgaaagctgattagtttcttttggttatggtacgtttgcctgattcattgattatccatgtattcttgtattggtgtctgtgcatgtgaagttacaaatacttcttgtccctacagactggtctcaatggttaaaaccttttcattttagttcctcaggcttagggaattgcctttgggttcaccataaagtggcattggagctggataatgtagctgttgctgcatccacagtaaggtctgcagtttgtagggctgctaccagtggctcaagcaagatgtatcctgtctggtccctgggtggactggactatcttcaagactttggttagtagggatgaccctgaaataagaatctgctttagattctgcagttgagtttacaaacagcaggtctattactgggtgtgcagctggatatggcactcctaatatgttactaagtgagaccatgttcaggcaggactggccttggaccatggctgagaatagctggaactgtcacaaggcagcctcagagtccaaagccaagaccacgttttgaaggtcttcctctagggacacagaagggtgtgcctccttccagcttcctgggtggagagaactaccccagactgtggctgagaaatctgcagctgggttgaagacctacttcaggataaacagttggtttgaggtctgtggacttgcctttgagagaatgaatggatatgtctccatgcatatccctaaattggcaggattatgctcagacagtagctgagaagagcttgagccaagttacagggccatttcaggatctgctgtggcactgaggtttgcaggctttccccattggacacagatgtgcatgtctcctggctgacctcttggtgggaaggactgtcctgaaatttcagctgagagggactagagcaaagttactgggccttttttggggatctgcaataagaccaaagtcagtgggcttgcctcaggggcacaaatgggggtatcttctggtgggcccccagataggcaatactactctcagaccacagctgagagatgctggtagcaagttatagagttggttcaagatttatagtgatgctgaaacagtgttcctgcttactgctaggagtaatgacaaggcacctccagcagtgatttccagcaagtccctgagctggtgggatttccagcctgtcaatgaaaagagctggagccaagttcaatgaccacttcagggtccacagctagcatctgtgttaacagacctgtcacccaaggcacaagtggctgtgacttctccccggtccttgggtaataattctggtggcaggaccaaggccaagcagcactatagttgagtagacaagacaaggaggtcatttatttatctgtaactgagaccaagttcagcaagcatcttacctaggcattgatctgacctcccacaacagccttcctcagtcttgggctccactcaggtttttcagtctttcacctagtctcaaaactctcaaaaaggcacttttttcatgaatggtttctaaattagtgttgctgtgtaaggatatctgcagaaaacctcttattctgctgtcttactcatgatataaaagtaatttgtaattttcatgacaattataataaaggcatgtaagagaatgtgaggattgacatttattgagcatgtacttatgtatctatctctatgctaggggctttgcataagttttcttgtttatgtttcataataaatgtataagataaatattattacattaagttaataggtgaagactcaacaatattgagtaatttaccaaatgtcatacatcacatgagtgacagagccaggattttgcctgactacaaatatcatgcactttgcactgtaccatatgtgactgcttgtgtataagttttgtttgctatgttaatattaaactactgagatatatatcttcatgttttaaatcaatttttaatttacacttactaaaatataatttttgttctaaattctgtgagtttggacaaatatataatcacaaaattataagtaagcccaagataaagaatattaacatcatcacacacaaaaatttttcttatcaaagcctttgtaatcactccctaccactacaaccaacccaaggaaaccactgatctgttcaatgttcctataattttgcctgtttcaaatgttatataaatgaaactatacttgagttcttttatttaacataatgcatttaaactctgtcaatgttgttacatgtgtcattagtttgctttttattgctgaagagtatttcatattatggatatactacaacttgaataatcattcatctacccattgatattaagattgtttctgactttgagctattgcaaataaaatcatgagtattcctgtgcaagtctttgtatggacatatatttccttttattttggtatatccctgaaagtagaatggcaggattatataataggtgtatgtttaactgcatttaatttttgttatttttgtgggtaaatagtaggtgtatatatttatgggatgcatgagatattttgatagaagcacacaatgtgcaataatcaaatcagggcaaatggagtatctatcacctcaggcatttatcttttgtgttaaaaagccaattatactcttttttttcaattatacccttattttataatgtacaagtaaattattactgactgtagtcaccctgttgtgctatcaaagactagatcttattcatttattctaattattttgataattattaatcatccccactttttcccccaaactccactatccttcagacatttttgtaaacatactttactctgtatcaccatgaattcaagtgttttaattttcaacccctacaaataagtgcgaacatgccaagtttgtattttgtggctgttttatttcacttaacatgatggcatccagtttcattcatgttaatgaaaattacagggtctcaattttttatgacagagtagtactttattgtgtatatgtactacactttctttatccattcatctgttgatggaaacttaggttgcttctaaattttgaatattgtaagtagagctctaataaacagggaaatgcagatatcttttaatataccaatttattttgatggtttgtttgtttgttttgttggtatactcccagcagtggggttgctgaattatatggtagttctatttttagtttcctgaggaacttccctgctattctccatcatggctgtactaatttacattctcaccaacactgtaccagttttcccttttctccacaccctaactagcatacactattgcctgtcttttggataaaagccattttaactggggtgagatgacatttcatcatatttttgatttgcatttacataataattaatgatgttgaggaccttcttatatgcccatttaccatttgcatttctttttttgagaaatgctattaatattctttacccttttttaatgtgattattaacttttttcttttagagttattttagctacttatatcaatcccttctcagatggatagtttgcaaacattttcttccatcctgtaaaagatatctgttgatgatacctgttgccatgcagaaggtttttcacttgaaatctgatttgtctatttttacttgggtttcctgtgcttgtgtatcagtattgttgcattgggttctatctttctctttacctttaataatatttgttttatatatctggatgcttcagtgttaagtgcatatatacttacaattgttatgctgttgtgatggttaatactgagtgtcaacgtgattagatggaggggtacaaagtattaatactggttgtgtctgtgtgggtgtttccaaaagagattaacatttgagtcagtgggttgggaaaggcagatccacccttaatctggtgggtacaatctagtcagcttccagtaaatataaagcaggtagaaaaacgtgaaaagtagagatgggcctagcttccaagtctacatctttctccgtgatggatgcttcctgtccttgaacatcagactcaaagttcttcggttttgggacttggactggctctccttgctcctcagcttgcagacaagctgagggaccttgtgatgatgtaaatttatatatatatatatatggaaccctgactaatacagatttttaataaactatatatataaaaccctaccaatgcagattttggtactgggagtgattctagaggaatagaatattaaggatggagttctttggttggttttggggtttctggagttggctgcttaatataattagaccccaaaatgctaaggactctacttctagtagtatggagaacactgatagtccttggccaaaactgtttagggagttatgcaaaataaatgcatttgacacacctgattcactgatcgagagaggcaaggagtttagtgactctatacattatacctttgaccatatgtggagaaccaaggaacataatgaacctggttggttgctcctaagttcagtggacaaaatgataaaagaaaatgatgaattgagggattctgtctcccagcttcagaagcagatactaaggttcaaatctgctaagattgccctgagtgagagtcttatcacctgtagagaaagagctgaaaatgggaaaaaacagacacaagctcttattatgcgagtgcctgacctgcaatgagagatgcatgtacagcctcgccagatgtctattgtaaaagtgtgggcattgactggaaaagaatggggtcctccaacttggaatggggaagtttggaggaccctaatgaagctgaggacactgagtttgtaaactctaatgaacattttttctgccagaagtaacagctttcccatctccagtagtggcaacatcccctccccgaacattgctgccatcagcctttccttgtttgtatgaggagataaaccctgtgctgctttaggaaacagtgagggcctcccctgaggcagctgccaggcaagataatgttgattcttctcagaagccaccgccaacacctctatttgcttctagacctataactagactaaagtcccagcaggcccctagaagtgagtttaaaagtgtgaccctttggatatatacccagtaatgggatggctgggtcaaatggtatttctagttctagatccctgaggaatcgccacactgacttccacaatggttgaactagtttacaggcccaccaacagtgtaaaagagttcctatttctccacatcctctccagcacctgttgtttcctgactttttaatgattgccattctaactggtgtgagatggtatctcattgtgcttttgatttgcatttctctgatggccagtgatggtgagcattttttcatgtgtcttttggctgcataaatgtcttcttttgagaagtgtctgttcatatcctttgcccacttttttgtggggttgtttgtttttctcttgtaaatttgtttgagttcattgtagattctggatattatccctttgtcagatgagtagattgcaaaaattttctcccattctgtatgttgcctgttcactctgatggtagtttctgttgttgtgcagaagctctttagtttaattagatcccatttgtcaattttggcttttgttgccattgcttttggtgttttagacatgaagtccttgcccatgcctatgtcctgaatggtattgcctagttattgcggcactattcacaatagctaagacttggaaccaacccaaatgtccaacaatgatagactggattaagaaaatgtggcacttatacaccatggaataccatgtagccataaaaaatgatgaattcatgtcctttgtagggacatggatgaagctggaaaccattattctcagcaaactgtcacaaggacaaaaaaaaccaaacaccacatgttctcagtcataggttggaattgaacaatgagaacacatgggcacaggaaggggaacatcacaccagggcctgttgtggggtggggggaagggggagggatagcattaagggatatacctaatgttaaatgacgagttaatgagtgcagcacaccaacatggtacaagtgtacatatgtaactaacctgcatgttgtgcacttgtaccctaaaacttaaagtataataataataaaaaagaaagtgtgacccatgaagtcacactacccatgaggtgtgctacccatgagggatggtacactcaaaaagaactgtttgagttctctaatttatataaacagcaatctggagaacaggcatgggaatggatattaaaagtatgggataatggtggaagaaacaaagttggataaggctgaatttactgatttgggtccactaagtagggactttgcatttaaatttgcagctcagggagttaaaaatgttctaatagttaatttgcttagttagctaaaatatggattaaaagatggtcaactgtgaataagctggaaatgcctgatctcccttagtttaatgtagagaaagggatccaaaggcttagggagattgggatggtgaaatggattagtcaatttagacctactcatcccagctgggagggtccagaagacatatgcttgacctgtgacttatgaaatagatttgtgaggaaatcatcttcctctttgaaaaaccctgtaattgctcttctttgtatgtcagatctaagggtggaactgcagtcattcagctacaaaatttaaatacaatgagaataattcgatcccaaggtggcaaggaccaagtggcagcactcaacagtcaaaggcaaggtgggtgtagctaccataatgaacagcacaggcaaagtgacaatcagaatagtctgacttgtgtagagctctggcattggctaattaatcatggtgttcctataagtgaaattgaatgccgtaagtctactgcattcccacttaaattataaaaatagaaaacttctaggtcgaaagaacagaagacttatttgaattataaaaacagaattatggcccctcaactaatttccagacttgacccagtttacagaaccagaaccccttgaatgaaagggaggccaggcccccttgaggaaggatcccactacattactgacactttatgcagtgaatctttctcccatccttccccaaggagacctccagccttttaccagggtaactgcattggggaaagggaaatgatcagacattttggggactactggacactggctctgagctgagattgattcaagggcacctataacatcattttggctttccagttaaagtaggggcttatggaggtaaggtaattaatggagttgtagctcaggtccaacttatagtgggttcaatggatccccagactcatcctgtggtcacttctccagtgtcagaatgcataattggcatagacatacttagccgctggcaaacccccacattggctccctgactggtagggtgaaggctgttctagtgggaaaagaaaaatggaagccattagagcttcctctacccagaaaaataataaatcaaaaacgatatctcatccctggagggattgcaaagattagtaccaccatcaaggacttgaaagacggaggggtgatgactcccaccacatcgtttttcaactctcccatttggcctgtgcagaagacagatggatcttggagaataacagataattgtaagcttaatgaagtggtgcctgcaaatgcagctgctcagccatatgtggttttattgtttgagcaaattaacacatctcctggtacctgatatgcagtcattgacttggcaaatgcctttttctccattgttgtccataaggcattccagaagcaatttgccttcagctggaaaggcaagcaatatatttttactgtcctacctcaggggtatattagctctccagctttgtgtcataatcttattcagagagaccgtgatcactttacacttctacaagatatcacactggtttgttacattgatgacattatgctgactggatccaatgagcaagaagtagcaaacacactggacttaagtgaggcatttgcatgccagaggatgggaaataaatcctactaaaatgtaaggaccttctacctcagttaaatatctatgggtccagtggtgtagggcctgtcgagatattccttctaaggtaaaggataagttgctgcatttggctcctcttacaaccaagaaaaaggcacaacgcctagtggcctattttgattttggagacaacacattcctcctttggttatgttactctagcccatttactgagtgacctgaaaggctgcaagtttttgagggggatacagaacaggagaaggctctccaacaagtccaggctgctgtgcaagctgctctgccactggggccatgtgacctcgcagatccaatggtgcttgatgtgtcagtggtagatagggaagctgtttggagcctttgacaggctcccataggagaactgcagcagggtcctcttaggattttggagcaaggcctagtcatcttttgcagataattattttccttttgagagactgctcttggtctgttactgggctttagtggaaactgtacgtttgactatgggtcatcaagtcaccatgggacctgaagtgcctgtcatgaacttggtgctttctgacccatctagtcataaagtgggtcatgcacagcaacattctatcatcaaatggaagtggtatatacatgatagggctcgagaaggtcctgaaggcacaagtaagttacatgaggaagcggctcaaatgcccatggtctctatttctgccaccctgacttctcacccccagcctgcaccaatcgcctcatgggaacttccctataatcagttaacagaggaagagaagactaggacctggttcacagatggttctgcacgatatgcgatatgcaggcacaacccgaaagtggacagctgcagcactacagcccctttctaggacatccctgagggacagctgtgaagggaaatcctctcactgggcagaacttcgagcagttcacctggttgtgcactttgcatggaaggagaaatggcgagatgtgcgataatatactgattcataagctgtagccagttgttgggctggatggtcaggaacttgaaagaagcatgattggaaaattgatgacaaagaaatctggggaagaggtatgtggctggacctctctgagtggtcaaaaactgtgaagatatttatgtcccatgtaagtggtcactaacgggtgacctaagcaatggaggagtttaataatcaagtggataggatgacccattctgttgaaaccactcagcctctttccccagccacccctgtcatcatccaatgggcccatgaacaaactggacatggtggcatgcatggaggttacacatgggctcagcaacatgaacttccactcaccaaggctgacctggctatagccactgctgagtgcccaatttgcctgcagcaaacaccaacactgagccctctatatggcaccattattcggagtgatcggccagccacctgatggcaggttgattatattggacctcttccatcatggaaagggcagaggtttgtcctcactggaatagactcttactccagatatgggttttcctattctgcatgcaatgtttctgccaagactaccatccgtggactcacaaaatggcttatccaccatcatgctattccacacagcattgcttcttaccaaggcactcactttatggctaaagaagtgcaacagtgggctcatgctcatggaattcattggtcttaccatgtttcctatcatcctgaagcagctggattgattgaatggtgaaatggcattttgatgtcacaattacaatgccaacaaggtgacaatactttgcaggcctagggaaaagttctctggaaggccatttatgctcttaatcagcatccaatatatggtactctttctcccataaccaggattcacaggtccaggaattaagaggtggaagtggaagtggcaccactcaccatcacccctagtgatccattagcgaatttttgtgtcctgttcctgtgacattacattctgatggcctagaggtcttagttccagaggaagaaatgtcaccaccagggacacaacaatgattcaattaaactggaagttcagattgtcaccaggacactttgggctcctccaacattgaagtcaataggctaagaagggagttacagtgttggctggggtacttgaccgggactatcaagatgaaatcagtctactactccacataggaataaaggaagagtaggcatggaatacaggagatccttagggtgtctcttagcattactatcccctgtgattaaggtcaataagaaactacagcagcccaatccaggcaggactacaaatgacacagacccttcaggaatgaaggtttgggttacctggccaggaaaaaactgacctgctgaggagcttactgaaggcaaagggaatacagaatgtctagtagaagaaggtagtcattaacactagctatgaccaagtggccagctgcagaaacgaggactgtaactgtcatgagcatttcctccttcttttgtcaaaaacgtatttgtgcatgtatacacttttactaagaaaacatcttcattatatttcctttttctttatcatgtgatgtaaggtttattgacttcatatcaacattcaagtattattaacttaacgtaacagtatttgggttggagattggtgcatttccaaatgtacgaaggatagttgtataatgttaggtgtaattatgacctcattattttctttttttttcttttatttctttttttttttttttttttttttttgagatggagtctcactctgtcgcccaggctggagtgcagtggaacgatcttggctcactgcaacctccacctcctgggttcaagcgatcctcctgcctcagcccccctagtagctgggactacaggcatgtgccaccacgcctggctaatttttgtatttttagtagagatggggtttcgccatgttggccaggctggtctcgaactcctgagctcaggtgatccacccgcatcggcctcccaaagtggtgggattacaggcttgagccactgcacccggcctcattattttctttatttgaagattatgtatgattctcgggagatgtgtatgggttcaagttgatgaggggtggacttgtgatggttaatactgtgtgccaacttgattgcattgagggaaagaaagtattaatcctgagtatgtctgtgtgggttttgccaaaagagattaacatttgagtcagtgggctggggaagtgagatccacccttaatctggtgggcacaatctaatcagcttccagtgactatcaagcaggcagaaaaacatgaacaggaaagatgggcctagcctcccagcctacatctttctcccatgctggacgcttcctgctcttgaacataagactccaagttcttcagttttgggactcagattggctctcattgctcctcagcttgaagacagcctattgagtaaccttgtgtttgtgtaagttaatacttaatttaccctttcattatatagtgaccttgtctcttatagtttttgtcttgaagtcacattatattatattgtcagcatgacagtacaatatcatattgtcagatataaatatatctactcctttttgttgtttcttttctttttgtgtgtgtggtctcctcttcttttgtttttcttttcctttttgtattttatttaaagaagctgattttcttgggagatatgttttaactgattgccttatatttttgtacacattgcatgttttttgatttgtagttaacatgaggcttgtaaatactctcttacaactcattattttaaactgatgacaacttaaaaatgattgcatcaaaaaacaaacaaaaactgataaaaccttagcactttatctgtccccctttttgttgttctcatttctatttatgttactatactatgtttggaaaagttgttatagttattattttgatgggtttcacttttagtatttctacttaagtttagtttacacaccacaaatagttttataatattctgtaattttctgtgtagttactattacccgtgagttttgtacctttagatgatttattcttgctcattaacatcccatctcttcctgattgaagaactccctttagcatttactgtggggcaagtctgttgttgatgaaatcccttggcttttgtttgtctgggatattatttcttcttcatgcttgaataatatttttattaaatatactattctagggtaaagtattgtttccttcgacactttaaatatgttataccactcattactggcctgtagggtttccactgagaatttgcttccagacgtattggagctccattgaatgcaatttgtttctattcttttgctgcttttaggatttttttcttatccttcaactttgggagttttatttaaatggcttaatgtagtctactttggttaaatctgctttgtattctacaacctttttgtacttggatactgatacatttatctagatttgggaagttcttcattattatttctttgaataaattttctacatcacctttctctctacctcttctacaaggccaataactcttagatgtacccttttgaaactattttctacgtcttctaggtttgcctcattgttttttattattttttgttttgtctcttctgattgtgtattttcaaatagcctgtcttcaagctcattaattctataatctgtttgatcaattcagcttttaaaagactatgatgaattatttagtatgtcaatttcatttttcaactccaaaatttctctttgattccatttaactcaattttttgttaaatttatctcatagaattctgaatttcttctctatgttatcttgaatttttttgagttcctcaagagagttattttgatttctctgttgaaaatgtcacatatttctgtttctctagaattggtccctggtgctttatttagttcattttgtgaggtcatgttttcctggagggtcctgatgctggtggatattttttagtgtccagacttgaagaattgggtatttattgtagactttgcagtgtgtgtatttttatactcatccttcgtgggtaggctttccaggtatttatagggatgggcattgtgatcgaagctctatctgtattaagcttagatcacaacacccaagtccttcaaattttattataagctcattactgctgtggttcctgtagtcttgtagaggtatcacctttgtggtcttggataagatagagaaaactctttggattatcaagaagagatgattgttctcttctgttactgtttccccaccaaaattgagtctctctgttttttctgagttgcctggagctaaaggcaacttagctattacctttgtggtcacaacaacagaaactgcactaagtcagtcctgaagccagcagagccctgggtcttactcaaggccctctgtactcactgcctatatttactcatggccttagggctctatgatcaatcagctggtagtaaatgtagccaggctaatcttcttctcttcatggcagcaagttctcccaggtcccaggtgggtccacaaatggcatctgggagccaggaactggggtcagtagccttaaaaattgacttctactctattttactgcagctatcctggtgcaagatacaggttttttttactctttcttttcttttccactagtagagggacttcccccttttgccaccatcaccacaggcccatagggagtactgccaggctactgccaatgtttacttaagggccaaaagttcttcagtcagcttgtggtgagtgctgccaggactatgagtcaaacttcaaggtattggactacactatgaacagaatagtccagaaatgccatttaagagccaactcctggaattagggaccccaagagtcaacttgttgctttacctttctgtggccaagctggtacctaaggtgcaagatgaagtcccctttacttttccctctgcttttctcaaactgaaggtatctctcaccataacctccacaactggaaatgtactgggtttcactggaagtcaacacatctcagagtctcacccaagacccatggcatgctacctgtgtattgttgctggttattcagggctttttagttaacaggtgataaagcttgtcataactgaatccttcccttcaaggcagtgagttctcttctagacactgggtgtttctagaaatgtcatctgagaggtagggcctggaatggggccctcatgactatgccaggtgccccattttactgtggttgagctggtatccaagttgccagaacaggctctctttatccttttctcttctttctcaaacaaaagaaaggagtcaattttgttgctgcaagctgtactgcctgggttttgaaaaacagttttgaagtcactttcttagccaccctggctgttgtctcactaggtttcatgccctgcaagaccactggcttcaagcccagcacagcaccagaacttgcctaggagttgcagtccttgtgacctagactacctttcaagcttatttcaggaccaaatatcctatggtagtggggcttgccaaattcaacttttgactgctgggttaggcaattctcttctgcctagggcaggtctaaatcctccctccagcactggctgagttctatttaccttttctttcccctttgacaggacagcactgaatctcagtgcaaggtatcacaatcactgcactttcctcccacaaatgcacagattctcacttcattccacacagctgctgtcaggggatgagagttgggtgtcactggcaattcaagattatcttttctaccctctttagtgtctctttcagtgaaatgaagttaaaacaatgtacaatgattatttgcctgatttttgtttctcatgtaggtaattttttgagtagatcattgttgaattggatatttcttaggggaggacaagacgtgaaggcctctattctgccatcttgctctgcctccactctaaacgaacttttcaatttcaggaactttttgtgaattccttagggggttatatacagatgaccactatggctgcaaatagaggtaatatgtttctttaattcccatccttttctttttgtttcatttattgttttatggctctggctaggactgccagtataataataaacagttggggagattggaaatctttgcattttttttttttatctaagggaaaaagctttctatcttttgccattaagtgcaatcttagttatacctttttttagatatgctttaatagaacactgaagtttccttctattcccagtatgtttagaatttcttttataaatatatgttgtttttttccaacgctttatctgtatctgagataacagcatttgttattaatttattgattagtaaaatatactggtttattttcaaataggtcttccattcctgggataagccatacttggtggtgaagtattaccatttttacatgtggctagatttggtttgttaatattttgttgatgatatttgcaacttgtttataataaatattagtctacagttttctatttcttgtaatgtctttgttgactttagaatcaagtaacactagcctcattaaatgagatgaaaaatgttcttcagttttctggaagagattttgtaaatcagtattttttttacttaatttttgcctaagtatatatggcttattaaccgtaaaagtcaactgaattggaattttctttcttggaaagtttaatccattttgtaatgaattaggactattcaggttgcccaatcatggttacatgagctttgctaacttgtgtttttcaatgaatttgtccattttgtctaagttgttgactttatgggcataacattgtttataatattctctgggtttgtaataatttcttttttttatgaacacgaatacattctttattgaagtactttaagcacattaacttttttgtgaacattgtgtatttattgaatgtcgcctttaaaacaatttttagcatgctatagagatgttgagaaacaatctcctttcttggacagaattagattagtcttttccattttatgtttttagcacatttttctgtatatatacttatgctttctttctacatagattattaagtttctttaatgattgggtttaattaattttatgactttatttatttttttatatttttaattttgttattattatactttaagttttagggtacatgtgcacaacgtgcaagtttgttacatatgtatacgtgtgccatgttggtgtgctgcacccattaactcgtcatttaacattaggtatatctcctaatgctatccctcccccctcccccaactgcacaacagtctccagtgtgtgatgttcccctttctgtgtccatgtgttctcattgttcaattcccacctatgagtgagaacatgtctgacttcaaactataatacaaggctacagtaaccaaaacagcatggtagtggaaccaaaacagagatatagaccaatggaacagaacagagccctctgaaataatgccgcgtatctacaactatctgatatctgacaaacctgacaaaaacaagaaatggggaaaggattccctatttaataaatggtgctgggaaaactggctagccatatgtataaagctgaaactggatctcttcctcacactttatacaaaaattaattcaagatggattaaagacttaaatgttagccctaaaaccataaaatccctagaagaagacctaagcaataccattcagggcataggcatgggcaaggacttcatgtctaaaacaccaaaagcaatggcaacaaaagccaaaattgacaaatgggatctaattaaactaaagagcttctgtacagaaaagaaactaccatcagagtgaacaggcaacctacagaatgggagaaaagttttgccatctactcatctgacaaagggctaatatccagaatctacaaagaactcaaacaaatttacaagaaaaaaacaaacaaccccatcaacaagtgggcaagggatatgaacagacacttctcaaaagaagacatctatgcagccaaaaaacacatgaaaaaatgttcgtcatcactggccatcagagaaatgcaaatcaaaaccacaatgagataccatctcacaccagttagaatggtgatcattaaaaagtcaggagcagaagctctgtgaggagggtagcagcaagtacagatgtagaagcaagttgggatttctccagagcaccaacaggcccagagcctagcactattctttgaagttaaattgatttttacataatgcattgcctagagtcttctgagctctagcttaatgaaaatatctgacaaagagaagccatgaagtccaggtttgcactcagaatgactcaatggaatatgcagatgcttttttgcctttaaatgaaagaaaactaatgcatccattggagattattttcttttttctgactcattgggcctccatctgtgtcagttacatagcatcactaagaatagcaaggatgcaaattactccttaggctaccaaaagtcattcactgtagacattttgtgaatttcagaaatagctgtaagatttgcctcaagggcataatggaaatttgctgagtaccttttagagtagttttctatcatctggttgcagaagtgaaaatgaggtgagatcgttatcacaagtccaagtttgaatttgaattaagtttccccatcccatcactcaggaactgatatggttttctttctaggtgtgtatatagggtgaaaacagcaggaaagggtggaaaaatcaaataagagtaataaaagaaatccaaataaaaaaaagaaagtaaaattatctctcttcactgacaatataattctatacctagaaaacccaaaatattttgccaaacattcctatatcttatgaatgacttcaccaaatctctgggtataaaataaacattaaaaaatcggtagcatttttctataccaataacattcaagctggttaccatatcaagaatgtaattccatgtaaaatacctaggaatgcatctgaccaaagaggttaaacatctgtataggaagaactataaaacacagctgaaagaaatcacacatgatacaaagaaatggaaaagcatgtcaggcttatggattggaagaatcaatatcatgaaaatgttcatattacacaaagcaagctacaaattcaatatgagttctatcaaattatgtcaattattcacaaaataaaaaaatctaaaattaatacagaagcaaaaacaagcctgaatagcttaggcaatcataagcaaaaagagtaaagccagaggcatcaacttcaaactgtactacaagggtacagtaatatatatatatatatgtgtgtgtgtatatatatatgtgtgtgtgtatatatatatatggacacagaggtcaatggaagggaattcatacctctgaaataaagtcatacacctacaaccaactgatctttgacaaagttggcaaaagtaaacaatggggaaagaaaatcctattcaataaatggttctgggaaaaatggctaaccaaatgcagaagaatgaaaccgaatccctccctctcacaatatacaagaattaacaaaagatgaattaaagacttaaatgtaagtcttcaatctataaaaattctagaataaaatataggaaatactcttctagacattggtctaagtaatgaatttacaatgaagacaacaaaagcaaatgcagctaaataaaaaatacacaaacaggactttattaaactaaagagcttctgctcagcaaaagaaacaactaatgtgataagcaaaaaacctacagattaggggaatatatttgcaaactatgcatttgacaaaagactaatatccagaatctataaggaacttaaatcagaaagaaaaagcaaatacctcttttaaaaagtgggcaatgaagatgaatagagacttctttttctctcaggttctctgtaaactttattagatgctctttttattatcatccattatgaaaaaattcaaatgaaaacagtacagagaatactataaagaactaataacccaatttcaaaaattaccaacatacaacccattttgttccaacaatatttcttatgctcctctcccactatagatactgaagcagacatcagatggtatattattttatctgttaaaattcagatagtcctttctgtgaaaaataaggactatttttgacttcatcattcctctcaatttaacaatcattccttaatatcaccaactatccatttagagcctacatttctctgattatctcataaatatctgcttacagttggtatcatttgaaaaattaattaacatttaaaatatgttaacagcatacaagtgcaagttccttacattcatatattgtgtagtgatgaagtatgggcttttagtgtatccatcacctcaatactgagcactgtatccaatgggtaaagtttaacccccacttataagtgagaacatgcagtatttgactgtttgtttctgagttaattcactgaggataatggcctctagtgccatcaattggtatcattttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattggtatcattttgaatcatgtcctaaacaagatccgtattgcttagtatgctttttcatagacctaaagagcacattatgacttttttaactttaaaaatgttatgcgtgatagcaatataggccttaaagtgtaagattaaatatataatagtgcaagggcatattaatcaaatagtaaaagcagtgaaaattactaaaatgtttggagtgcaaggaacttttttatgtacattatctcatttaaatctttttttattattttaagtactgggatacatgtacagaatgtgcaagtttactacataggtatacatgtgccatggtggtttcctgcacctatcaacccatcatccagggtttaatccctgcatgcattaggtatttttcctaatgctctccctccccttgcctcgcaccccctgacaggagtgtgtgatgttcccctccctgtgtccatgtgttctcattgttcatctcccacttataagtgagaacatgcggtgtttgattttctgttcctgtgttagtctgctgagaatgatactttccagcttcatccatgatgatgcaaaagacatgaactcattcttctttatggctgggtagcattccatggtgtatatgtatcacattttctttatccagtacatcatcgatgggcatttgggttggttccaagtctttgctattgtaaatactgctgcaataaacatatgtgtgcatgtgtataatgatttataatcctttgggtatataccgagtaatgggattgctgagtcaagtagtatttctgcttctgtatccttgaggaaacaccacactgtcttccacaatggttgaactaacttacacttccaccaacagtgtaaaagtgttcctatttctccacagcctcaacagcatctgttgttttttgagtttttaataattgccattctaatgggcatgaaatggtatctcattgtggttttgatttgcatttctctaatgaacagtgatgatgagctttatttcatatgtttgttggctgcataagtgccttcttttgagaagtgtctgttcatatcattcacccaaattttgatggtttttttcttgtaaatttgattaagttccttgtagattctggatattagacctttattacatgggtagattgcaaaaattttctcccattctgtaaatttcctgttcacgctaatgatagtttattttgctgatcacaagctctttagtttgattagatccccttcatcaattttggctttagttgcaattgcttttggtgttttatttaagaagtctttgcacatgcctgtgtcctgaatggtattgtctaggttttcttctagggtttttatcattttagatttttacatttaagtctttaatccatcttgagttaatttttgcataaggtgtaaagaaggggtccagtttcagttttctgcatatggctagccagttttcccagcaccatttattaaatagggaatccctttcccattccttcttttggtcaggtttgtcaaagaccagatgattgtagatgtgtggtgttatttctgaggtctctgttctgttccattggtcagtatatctattttggtaatagtaacatgttgccttggttactgtagccttgtagcatattttgaagtcaggtggcatgttgcttccagctttgttctttttgcttagggtagtcttggctatacgggctcttttttggttccatatgaaatttgaagtaattttttctagttctgcaaagaaagccaatggcagcttaatgggaatagcattgaatctataaattactctgggcaatatggccattttcacgatattttttcctcctatccatgagcatggagtttttttctatttgtttgtgtcttctcttatttccttggacagtggtttgtgttctccttgaagaagtccaggtcccttttaagttgtattcctaggtattttattctctttgtagcaattgtgaatgggagttcactcatgatttggctctctggttgtctattgttggggtataaaaatgcttgtgatttttgcattgattttgtatcctgagactttgctgaagatgcctagcagcttaaggagtctttggtctgagatgatggggttttctaaatgtgcaatcatgtcatctgcaaacagaaaatttactttctgtcttcctatttaaatacactttatttctttctcttgcctgattgccctggctggaacttctaatactatgttgaataggagtggtgagagagggcatctttgtcttgtgccagttttcaaagggaatgcttccagcttttgcccattcagtatgatattggctatggttttgtcataaatagctcttactattttgagatatgttccaaatagacgcttttttataaaagacatttgtggctgggcatggtggctcatgcttgtaatcccagcactttgggaggtgtaggttggcagatcatttgagtgcaggagtttgagagaagcctggctaacatagcaaaactctatctctactaagaatacaaaaaaaaaaaaaatagcttgacatggtggcacatgcctgtaatcccagttactgaggaggctaagaaatgagaattatttaaacctgggtgacagaggatgcagtgagctgaagtcacatcatttcactccagtcttggtgtcatttctgtctcaaataaataaataaaaataaagaagacatgtaagtggccaaaaaacatgaaaaaattcttcacatcactaatcattagagacctgcaaataaaaccacaattagataccatctcacaacagtcagaatgagtagtattaaaaaataaaaataaaaaaagtcactggcaagacggctgaataggaatagctctggtctgcagctcccagtgagatcaacacagaaggtgggtgatttctgcatttccaactgtggttcccagatcatctcattgggactggttggacagtgggtgcagcccatggtgggtgagcagggtggggtgttgcctcacctgggaaatgcaaggagtcaggggatctaactcccccagccaagggatgccatgagagactgtattgggaggaacggtgcactcccgcccagataccgcatttttcccatggtcttcacaaccagcagaccaggagattctctccggtgcctatgtcacaagggccctgggttccaagcacaaaactgggcagccatttgggcagacactgagctagctgcatgagttttgtttttcttttctccatacaccagtggcacctggaacaccagtgagagagaaccattcactcccctggaaagggggctgaagccagggagccaagtggtctggctcaacaggtcccacctccacagagtccaagctaagatccactggcttgaaattcttgctgctagtacagcagtctgaggtcaatctgggatgctggagcttggtggggggagggccatttgccattgctgaggcttgagtaggcagttttacccttacagtgtaaacacagctgccaggaagtttgaaattggcagaacccaccacagctaaacaaggccattgcagccagactgcctctctagaatcctcctctctgggcagggaatctctgaaaaaaaggcagcagccccagtcaggaacttgcagataaaccccctatctccctgagacagagcacctgggaaaaggggcagctgtgggcacacctttagcagacttaagtgtccctgcctgatgtctctgaagacagcagcggatctcccagcacagtctttgagctccaataagggacagactgcctcctcaagatggtccctgacctcatgcatcctggctgggagacacctcccagtaggggtggacaaacacctcatagaggagagctctggctggcatctggcaggtgcccctctggaatgaaacttccagaggaaggaacaggcagtaatcttttctgttgtgcacctcccctggtgatacccaggcaaacagtcaggagtggacctgcaacaaactccagcagatctgcagcagaggtgcctgactattagaaggaaaactaacaaacagaaaggaatagtatcaaagtcaagaaaaaggacatctactcagagaccccatccgaaggtcatcaacatcaaagaccaaaagaatagtatcaacatcaacaaaaagtacatccacacagaaaccctatcctaaggtcatcaacatcaaagaccaaaggtagataaatccacaaagatggggagaaaccagcgcaaaaaggctgaaaattccaaaaaccagaactcctcttctcctccaaaggatcacaactcctcaccagcaagggaacaaaactggacagagaatgagtttgaagaattgacagaagtaggcttcagaaggtgggtaataacaaactccttcaagctaaaggagcatgttctaaccaaatgcaaggaagctaagaaccttgaaaaaatgttagaggaattgctaactagaataaccagtttggagaagaacataaatgacctgatgaagtgaaaaacacagcacgagaacttcatgagtcatacacaagtatcaatatacaaatcgaccaagcagaagaaaggatactagagattgaagattaactcaatgaaataaatcgagaagacaagattagaagaaaaagagtgaaaagaaacatacaaagcctccaaaaaatatggaactatgtgaaaagatcaaatctatgtttgactggtgtacctgaaagtgatggggagaattgaaccaagttagaaaacgctcttcaggatattatccaagagaactcccccaatttatcaaggcaggccaacattcaaaatcaagaaatatcaagaacaccacaaagatactcctcgagaagagcaaccccaagacatataatcaacagattcaccaagtctgaaatgaaggaataaattttaagagcagccagagagaaaggtcgggttatccacaaagggaagctcatcagactaacagtggatctcttggcagaaaccctacaagccagaagagagtggaggccaatatttaacattcttgaggaaaagaattttcaacccagaatttcatgtccagacaaactaagcttcataagtgaaggagaaatgaaattatttacagacaggcaaatgctgagggattttgttaccaccaggcctgccttaaaagagtgcctgaaggaagcactaaacatgaaaaggaaaaaccagtagcagccactgcaataacataccacaataaaagaccaacaacactgtgaagaaactgcatcaactaatgtgcaaaataaccagctagcatcatgatgacaggatcaaattcacacataacaatattaaccttaaatgtaaatggcctaaatgtccccaattaaaagagacagaccaacaaattggataaagagtcaagacacttcggtgtgctgtattcaggaggcccatctcacatgcaaagacacacataggctcaaaataaagggatggaggaatatttacaaagcaaatggaaagaaaaaaaagcagaggttgcaatccaagtctccgataaaaaaagactttaaaccaacaaaaatcaaaagaaacaaagaagagcattacataacggtaaacagatcaatgcaacaagaagagctatctatcctaaatatatatgcacccaatacaggagcacctagattcataaagcaagtttttagagacctacgaggagacttagactcccacacaataataatgggagacttaaacactccactatcaatattagacagatcaatgagagagaaaattaacaaggatatccagaacttgaactcagctctggaccaagaagacctaatagacatctacagaactctccaccccgaatcaacataatatacattcttctcagcaccacatcccacttattctaaaattgaccacataattggaagtaaaacactcctcagcaaatgcaaaagaacggaaatcataaaaaatagaatctcagaccacagagcaatcaaattagaactcaggattaagaaactcactcaaaactgctcaactacatggaaactgaacaacctgttcctgaatgattactggataaataatgaaattaagggagaaataaagacattttttgaaaccaatgagaacaaagacacaatgtatcagaatctcttaaacacatttaaagcagtgtgtagagggaaatttatagcactaaatgcccacaagagaaagcaggaaagatctaaactcaacaacctaacatcacaataaaaaagaactagagaagcaagagcaaaaaattcaaacgctagcagaagacaaggaataactaagatcagagcagaactgaaggagatacagacacgaaaaacccttcaaaaaaatcaatgaatctaggagctggttttttgaaaagatcaacaaaatagatagaccactaaccagactaataaagaagaaaagagagaaaaagcaaatagatgcaaaaaatgataaaggggatatcaccaccgaatccacagaaatacaaactaccatcagagaatattataaacacctctatgcaaataaatttgaaaatctagaagaaatggataaattcctggacacatactccctcccaagactaaaccaggaaaaagttaaatccctgaatagaccaataacacgttctgaaattgaggcagtaattaataccctaccaaccaaaaaaaaagtccagaaccagatggattcacggcctaatttcatcagaagaacaaaaaggagctggtaccattccttctgaaactattccaaacaatacaaaaagggaatcctccctaactcgttttgtgaggacagcattatcctgataccaaaatctgacagagatatgaccaaaaaagaaaatttcaggccaatatccctgatgaacatagatgcaaaaatcctcaataaaatactggcaaaccaaatttagcatcacatcaaaaagattacccaccacgatcaagtcagcttcacctctgggatgcaaggctggttcaacatacgcaaatcaataaacgtaatccattgaataaacagaatcaattacaaaaaaacacatgattatctcaatagatgcagaaaaggtcttcaacaagattcaaaagcccttcttgctaaaaactctcagtaaactaggtatggatggaatgtttctcaaaataataagagctattaatgacaaacacactgtcaatatcatgctgaatgggcaaaaactggaagcattccctttgaaaaccaacacaagacaaggatgccctttctcacctctcctattcaacatagaattggaagttctggcaagggcaatcagtcaagagaaagaaataaagggtattaaattaagaggatgtcaaattgtctctgattgcagatgacatgattgtatatttagaaatccccatcgtctcagcccaaaatctccttaagctgataagcaaatgaagcaaagtctcaggatacaaaatcaatgtgcaaaaatcacacgcatttctttacacaaataacagacaaacagagagccaaatcatgagtgaactcccatttgcaattgctactaggagaataaaatggaatataacttagaagggatgtgaagtacctcttcaaggagaactacaaaccactgctcaacaaaataagagaggacacaaacaaatggaaaaacattccatgctcgtggataggaagaatcagtgttgtgaatatggccatactccccaaagtaattcatagatccaatgttattcccatcaagctaccattgactttcttcacagaattggaaaaaacatactttaaatttcacatggaaccaaaaaggaggccacatagccaagacaatcctaagcaaaaagaacaaagctagaggcatcacgctacctgacttcaacctatactagaagcctacagtaacaaaaacaatatggtactggtaacaaaacagatatatagaccaatgaaaaagaacagaggcctcagaaataacaccacacatctacaaccatctgatctttgataaacttgacaaaaacaagcaatgggaaaggattccttatttaataaaatggtgttgggaaaacaggctagccatatgcagaaagatgaaactggatccctcccttacaccttatacaaaaattaactaaaaatgtataaagacttaaacgaaagaccctaaaacataaaaaccctaaaagaaaaccaaggcgataccattcagaacataggcatgggcacagacttcacgactcaaacacaaaaagcaatggcaacaaaagccaaaattgacaaatgcgatttaatcaaacaaaagagcttctgcacagcaaaagaaactaccatcagagtgaacagacaacctacagaatgggagaaaatttttgcaatctatccatctgatgaagggctaatatccagaatctacaaaaacttaaacaaatttacaagaaaaaaaaagaaccccatcaaaaagtggacaaagtattttaccagacagttctcaaaagaagacatttatgcagccaacaaacatatgaataaaagctcatcatcactggtcattagagaaatgcaaatcaaaccacaatgagatgccatctcatgccagttggaatggcaattattaaaaagtcaggaaacaacagactctggagagggtgtggagaaataggtacgcttttacactgtcggtgggaatgtaaattagttcaaccattgcggaaaacggtgtggtgattcctcaaggatttagaactagaaataccaattgacccagccattccattactgggaatatacccaatgtattataaatcattctactgtaaagacacacgcacacatatgtttattgagacactgttcacaatagcaaagacatagaaccaaaccaaatgtccatcagtgatagactgtataaagaaaatgtggcacatatacactatggaatactaagcagccataaaaaaggatgagttcatgtcctttgcagggacatgaatgaagatgtaaatcatcatcatcattctcagcaaacacagaaaaagaaaaccaaacacctcatgttttatatatatatacatatatatatatatatatgtatatatatatgtatatatatatatatttatatttatatatttatatatatatatatttatttatatttatatatttatatatatattattttttattatactttaagttttagggtacatgtgcacattgtgcaggttagttacatatgtatacatgtgccatgctggtgtgctgcacccactaactcgtcatctagcattaggtatatctcccaatgctattcctccaccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccatattttcttaatccagtctatcattgttggacatttgggttggttccaagtctttactcttgtgaataatgccacaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgttttttcttgtaaatttgtttgagttcattgtagattctggatatcagccctttgtcagatgagtaggttgtgaaaattttctctcattttgtaggttgcctgttcactcgatggtactttcctttgctgtacagaagctctttagtttaattagatcccatttgtcaaatttggcttttgttgccattgcttttgttgttttagacatgaagtccttgcccatgcctatgtcctgaatggtaatgcctgggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgcagatatgctgcgttatttctgagggctctgttctgttccattgatctatatctctgttttgataccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctgcccatgagcatggaatgttcttccatttctttgtatcctcttttatttccctgagcagtggtttgtagttctctaactctttttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccataatcaagtgggcttcatccctaggatgcaaggttggttcaatatacgcaaatcaataaatgtaatccagaatataaacagagccaaacacaaaaaccacatgattacctcaatagatgcagaaaaagcctttgacaaaattcaataactcttcatgctaaaaactctcaataaattaggtattgatgggacgtatttcaaaataataagagctatctatgacaaaccgacagccaatatcatactgaatgggcaaaaactggaagcattccctttgaaaactggcacaagacagggatgccgtctctcaccactcctattcaacatggtgttggaagttctggccagggcaattaggcaggagaaggaaataaagggtattcaattaggaaaagaagaagtcaaattgtccctgtttgcagacgacatgattgtatatctagaaaaccacattgtctcagcccaaaatctccttaagctgataagcaacttcagcaaagtctcaggatacaaaatcaatgtacaaaaatcacaaacattcttatacaccaacaacagacaaacagagagccaaatcatgaatgaactcccattcataattgcttcaaagtgaataaaatacctaggaatccaacttacaaggcatgttcttactcataaatgggagttgaacaatgagaacacatggacacggggtggggggcatcacacaccaggtactgttggggagtggggggtgggggctggatagcatcaggagaaatacctaatgcagatgatgggttgatgggtgcagcaaaccaccatggcacgtgtatacctatgtcacaaacctgcatgttctgcacaggtaccccaggacttaaataaaaaataaaaagcaggtgttaccgaggctgcaaaaaaaagggggggtatatttatatactgttggtgggaatgcaaattagttcagtcactgtggaaagcagtttgtagatttctcaaagaatttaaaacagaactaccatttaacccagcaatcctcttactgtgtatatatccaaaagaaaataaatcattctaccaaaaagacatctgcatttgtatgttcattgcagccctgttcaaaatagcaaagacagggaatcaacctaggtgcccatcaactatcaactggataaaggaaatgtgttacatacacaccatgacgtgttacacaggcttaaaaaaagaataaatttatgtttttttttgcagcgacatggatgcagctgaaagcaattgttataagcaaattaatgcagggatggaaaaacagatgccacatgttctctcttataagtggaagctaacaaccaggtaagtacggtaacaaagatgggaatggtagacactagcgactctcaaagaagggaaggggaaacagacagtgattgaaaaacaacctatcaagtactgtgttcaccccttgggaaataaaatcattagaagtccaaacctcagtatcacaccatatactcatgtaactaacctgtgcatgtatttcctgaatctaaaatttgaaaaaataaataaataaaatattttaaaactgtatttgttttaaatgtacagtgtaatttatatatatatatatacacattgtgaatttataaccacaaccaagctaattaacatatatattatctcagttacctttttgtgataaggacatttaagatctattctcagcaaattgaagtataccaaatagtattatcaactacagttgctatactgtacattacatctacaacttattcactcttcatatctaaaactctgtacccttctccaacttttccccattttcctaaccctcagcccatggaagctacctttctactgtttctgtgtgcttgactattttagtttccccatataaatgagatcatacaacatgtatctttctgtttctgtcttatatcacttaacataatgtcttccaggtttttccacgttggtgaaaatgacatgacttctgtcttttgtaagtctgaataatatttctttattttattttattattactatactttaagttttagggtacatgagcacaatggacaggtttgttatatatgtatacatgtgccatgttggtgtgctgcacccattaattcatcacttagcattaggtatatctcctaatgctatccatcccccctccccacaccccacagcagtcccctgtgtgtgatgttccccttcctgtgtccatgtgttctcattgttcaattcccacctatgggtgagaacatgcagtgtttggttttttgtccttgtgatagtttgctgagaatgatggtttccagcttcatccatgtccctacaaaggacatgaactcatcatgtttatggctgcatagtattccatggtgcatatgtgccatattttcttaatccagtctattattgttggacatttgggttggttccaagtctttctattgtgaatagtgctgcactaaacatacatgtgcatgtgtctttatagcagcatgatttataatcctttgggtatatacccagtaatgggatggctgggtcaaatggtatttctagttctagatccctgaggaatcgccacactgacttccacaatggttcaactagtttagggtcccaccaacagtgtaaaagtgttcctatttctccacatcctctccagcacctgttgtttcctgactttttaatgatcgtcattctaactggtgtgagacggtatctcattgtcgttttgatttgcatttctctgatggccagtgatgatggggattttttcctgtgtgtttcagctgcataaatgtcttcttttgagaagtgtctgttcatatccttcacccactttttcatggggtttgatttttcttgtaaatttatttgagttcattgtagattctggatattagctctttatcagatgagtaggttgcaaaaattttctcccattctgtaggttgcctgttcactctgatggtattttgttttgctgtgcagaagctctttagtttaattagttcccatttgtcaattttggcttttgttgccattgctttttgtgttttagacatgaagtccttgcccatgcctatgatctcaatggcattccctaggttttcttctatggttttaggtctaacgtctaagtctttaatccatcttgaattaatttttgtataaggtgtaaggaagggatccagtttcagttttctacatatggctagccagttttcccagcaccatttattaaatagggaaacctttccccattgattgtttttgtcaggtttgtcaaagatcagatagttgtagatatgcagcattatttcagagggctctgttctgttccattggtctatatctctgttttggtaccagtaccatgctgttttggttactgtagccttgtagtatagtttgaggtcaggtagcatgatgcctccagcttgttctcttggcttaggattgacttggcaatgtgggctcttttttgattccatatgaactttaaagtagttttttccaattctgtgaagaaagtcattggtagcttgatagggatggcattgaatctataaattaccttgggcagtatagccattttcacgatgttgattcttcctacccatgagcatggaatgttcttccatttgtttgtatcctcttttatttcattgagcagtggtttttagttctccttgaagaggtccttcacatatcttgtaagttggattcctaggtattttattctctttggagcaattgtgaatgggagttcactcatgatttggctctctgattgtctgttattggtgtataagaatgcttgtgatttttgcacattgattttgtatcctgagactttgctgaagttgcctatcagcttaaggagattttgggctgagacgatggggttttctagatatacaatcatgtcatctgcaaacagggacaatttgacttcgtcttttcctaattgaatgccttttatttccttctcctgcctgattgccctggccagaacttccaacactatgttgaataggagtggggagagagggcatccttgtcttgtgccagttttcaaagggaatgcttccagttttggtccactcagtatgatattggctgtgggtttgtcatagatagctctgattatttttgagataagccccaccaatatctaatttattgagagtttttagcgtgaaaggttgtaaataaagatgttctttgaaaccaacgagaacacatacacaacatactagaatctctgggacacatttaaagcagtgtgtagagggaagtttacagcactaaatgcccacaagagaaagcaggaaagatctaaaattgacaccctaatatcacaattaaaaggactagagaagcaagataaaacattcaaaagctagcagaagacaagaaataattaggatcagagcagaactgaaggaaatagagacacaaaaatcccttcagaaaatcgatgaatccaggaactggctttttgaaaagatcaacaaaattgatagactgctagcaagactaataaagaagaaaagagagaagaatcaaatagatgcaataaaaatgataaaggggatatcaccaccgatcccacagaaatacaaactaccatcagagaatactataaacacctctacacaaataaactagaaaatctagaagaaatggataaattcctcgatacatacaccctcccaagactaaaccaggaagaagttgaatctctgaatagaccaataacagtttcttaaattgaggcaataattaatagcttaccagccaaaaaaagtccaggaccagatggattcacagccgaattctaccagaggtacaaggaggagatggtaccattccttctgaaactattccaatcaatagaaaaagagggaatcctccctaactcactttatgaggccagcatcatcctgatatcaaagcctggaagagatacaacaaaaaaaagagaattttacaccaatatccctgatgaacatcgatgcaaaaatcctcaataaaatactggcaaaccgaatccagcagcacatcaaaaagcttatgcaccatgatcaagtgggcttcatccctgggatgcaaggctggttcaatatatgcaaatcaataaatgtaatccagcagataaacagaaccaatgaaaaaaacacatgattatctcaatagatgcagaaaaggcctttgaaaaaattcaacaccccttcatgctacaaactgtcaataagttaggtattgatgggacttatctcaaaaaaataagagctatctatgacaaacccatagccaatatcatactgaatgggcaaaaactggaagcattccctttgaaaatcagcacaagacagggatgccctctctcaccactccttttcaacatagtgttggaagttctgtccagggcaattaggcaggagaaggaaatcaagggtattcaattaggagaagaggaagtcaaattgtccctgtttgcagatgacatgattgtatatctagaaaaccccatcgtctcagcccaaaatctccttaagctgataggcaacttcagcaaagtctcaggacacaaaatgaatgtgcaaaaatcacaagcattcttatacaccaataacagaaacagagagaaaaatcatgagttaactcccattcacaattgcttcaaagagaataaaatacctaggaatccaacttacaagggatgtgaaggacctcttcaatgagaactacaaaccgttgctcaatgtactaaaagaggatacaaacaaatagaagaacattccaagctcatgggtaggaagaatcaatatcatgaaaatggccatactgcccaaggtaatttatagattcaatgccatccccaacaagctaccaatgactttcttcacagaattggaaaaaaactactttaaagttcatatggaaccaaaaaaaagccggcattgccaaggtattttatatgcttttaaatttcaatttcatttatttcttctctgtttcttattattttattgtttttacctattttgggtttggtttgccccacttttctagttctttaatattcattgttaagtttttttatttgaagttgtttcttttttgatgtattttcttatatttataaactccttctttgtaccaattttgttattttttataggttttggtatgttgtgtttttactatcatttctttcaaggaattttttgattgatttctaaatttctttatttatctgctggtcattcaggatcgtattgtttaattttcgtgaatttgtagcgtttccacaattccgctttttattattttctactttttttccattgtggtcagagaagatgcttgatataacttcaattttttaaatgttttatgaagtattttgtgacctaacatatggtctatccttcagaatactctatgtgctgaagaaaaaaaatgtgtattcttcagctgttagataaaatgctttaaatatttatgagatcatattaatctatagtgcagattaattctgactttttttggttgattttctgcctggaatatctgatcaaagttaaaagtggagtgttaaaatctccaggtgttattgtattggggtctatctctctttttaggtgtaataatattttcttcatatgtgtgggtgctccagtgttggatgcatatgtatttaaaattgttatgtcctgttgccgtatacaccccttcatcattacatagtggccttcattgtctcttcttgtaatttgtgtcttaaaatctattttttctgatataattattgtgacttttgttatattttggtttccattggcatggaatatcatttttattcctttattttcattctctttatgtctttacagatgaagtgtgtttcttggtggctacagattaatgggtctttttttttattcattgagccagtctgtgtcttttaattgaagggtttagtccactgacattcaatgttattattgataagtaaaggcttactcctgtcaccttattgttgtatggttgctttgtggcctactcttctttcttttctttcagttttcctctagtaaaggtcatttttttcctagtgatatcgtttagtttcttgctttttattgtgtgtcccttgtatgttttttggtttgaggctaccatgaaacttgcaaatattctcttataactgtgttttaaccttataacaacttaaaactattttcataaacaaacaagcaaaaagatatctaataaaataaacagccttaattttgttcccccactttttaacattttgttgtttctatttgccgagaccagctaggttggggagaacctaacccagtggcactagagaaattaaagacacacacacacaaatatagaggtgtgcagtgggaaatcaggagtctcacagccttcagagctgagagcctcaaagggagatttatccaagtatttattaacagcaagccagtgataagcatagtttctatagattatagcttaactgaaaatattccttatgggaaacaaagggatgggcggaaataaagggttgggtttggttagttatctgcagcaggagcatgtccttaaggcacagatcactcatgctattgtttgtggtttaagaacgcccttaagcggttttctgccctgggtgggccaggtgttccttgccctcattctggtaaacccgcaaccttgcagcgtgggcgtcatggccatcatgaacatgtcacagtgctgcagagattttgtttgtggccagtttgggggccagtttagggccagatttttgggggcctgttcccaacactagttatatcttattgtactgactatgacttcaaaagttgttgtaattattatttttgattttttcatcagtctttttagttagggtaagagtagtttacacactacagtaacagtgttacaatattctgtgtttttctgtttacgtactattaccagtaaggtttcatcttttgggtgattattttttgctcattaacgtccttttctttttttattgaagtaccccctttagcattttttgtaggatggatctggtattgataaaatcctcagcttttgtttgtctgtgaaggtctttatttctccttcatgtttgaggaatattttctccagatatattattctagagtagttttttttcttcagctctttatttatttaatgagatggagtcttgctctgtcacccaggctggggtgcagtggtgtggtctcagctcactgcaacctctgcttcctgggtttaagtgattctcatgtctcagcctccctagtagctgggattacaggtgcctgccaccatgtctagctaatttttttttttttttcagtggagacggggttttgccatgtttaccaggctggtcttgaactcctgacctcaggtggtctaccttcctcagcctcccaaaatgctggaattacaggcctgagtcaccacacccagcgtccttcagcactttaaatatgtcattctactctcctagtctgtaaggtttccactgaaaaggctgttgccaaccttattggagctccattgtatgttacttgtttcttttctcttgttgcttttaggatcctttctttatacttgatatttgggagtttgattattaaatgacttgaggtagtcttgtttgggttatatctgcttggtgttctaaaacctccttggacttagacattaatatctttctccaggtttaggtatttctcttttactatatatttgaattaactttctatccctatgtctttctctacctactttttaaggtgaataagctttaaatttgcctttttgaggtgattttctatatcttgtttgtgctttattgtttttctattcttttttcttttatctctgactgtgtattttcaaataacctgtttttttagctcactaattctttcttctgcctgattcaatctgctattaaataactctgatgtattcttctgtatgttaattgcaccgttcacctccagaaattctgcttgactctttttgattatttcaatctttttcaatgtatcagatataattctgaattccttctctctgttaccttgaatttctttgggtttcctcaaaacagctattttgaattctctttctgaatggtcgcatatctctgtttccccaggattggatttttttgttccttatttagtttacttggtgaggtcatgttttccaggatggtattgatgtttctagatgtttttcagtgcctgagtattgaagatttaggtactttttgtaggctttattgtctgggcttatttgtggctgtcttcttgggaaggcttttctgatatttaaaatgatttctgttttgtgatctaaactgtgtctgctttagggggcaccccaagaccagtaacactggtttctcgcagacccatagagatactcttttgatggccttggacaaaatctgtgagaattctctggattattaggaagagactcttgttctcttactttttcctaaacaaatgaagtctttttttctgtgatgaaccacctaaaggtgggggtagggtgacacaagcattcctttggtgaccaccactatgaatgtgctgggtcagacatgaagccagtatggtgctgggtctttacctaggcctgctctaaccactccctggctactgcctatgttcacttaagttgctagggctctacaatcagcaaaaggcaatgccagtcagtattatgtttttcctttcagggtgacaaggtccaccaggccctgggtggttccagaagtgcaatcagggagtcagtgactagagtcaaaaaccttagaattctatctggtatcctattgtactgtggctaagctggcactcaaactacaaaaggcagttcttcccactctttcctctactttgcaaaatcagaagagcctcaccaagtagccaccaccccagtcaatgaggactacttccagactaccactgatgttcccttaatgcccaagatttcttaagtcaacttgagtgactgctgccttatctgggactcatacttcagggcagtgagcagccctctagcccagggtaggtccagaaatgccatccaaaagtcaagttctggaatgggggaatgtaagtttccacttggtgttctaccccactgtgacagtgttggtacctgaggccagcaagccacagaggctcaccaaggccaatgttttagtacctggttattgctgatggttattcagggtccaaagtctcttcagttagcagatgatgaatgcttctatgataggggcattcccttcaaggcagcaggtttatttattgcccacagtgtgactagcaatgtcatctgggagctagggtctggtatggggtcctcattactctcagcagtgccctgtggctgagctggtatcctagatgcaagaaaaagttctccccactcttcactcttctctcctgaaacataaggagggggtcaattttggagtggaaaaaggggtctcttttggagccctgagctgtaaagcgggagttagaggaggggtaatgccagtactcccttgtctgccccagctggtgtctcagtatgtcatgtgttgtccgcattccactgtgtctgggccaattttagtcctaggacttgcctaatacatgcagtagtccttatagcctagagtacctttcaagtttacttagtgaccaagagcactttggccctcagtggtcagtatggcaggcacttgtgttcagataggttggattggtgattctccttttgctggggctgatttaaatgctctctctgtgggcaggcatcagctgagtttggtctggcttttctttctgctctaacagagcaccacggagttcagtgcctcacaatttccaggttcttcttcccccactgcccagagatgcttccccaacaggttaccacttctaggtgtggggaaggtgtggcatccacaattgagcactgttttctttttttctatcccttcagtgcctctttcagcaatataatgttaaaaccaggtattatgagtgctcacctgattgttttgtttttatgaaggatcttttcttttttttctttttttttctttttttttttttcctgcgtagatagttgttaactttgtgtctttgcgagggaacaattggtggagttttttatttctccatcctgctcttcatcctgtagatgtctattggttgcatttggtcaaatatcactttcaagtcccaaatatatctgtttgtttcctgcctcaatgatctaatactgtcagtggggtgttaaagtctccctctattatttttggacatttaagtttattcctaggtatctgagaacttccattctgaatctgagtgctcctatgttgtatgcatgcatatttaagaaagttaggtcttcttgtcgaattaacccttatatcattatgtaatgctcttctctttcttgtttttgttggtttatcacctgctttgtctgaaattataacaacctatgtctttttctgttttcacttgtttggtattgatctccatttatttactttaagcctatgtgtgacattgcatgtgagatgagtcttatgaagaaagcataactttgggtcttgcttctctatacaatttaccactctaagcattttaattagggcatgtagcccatttacattcaaggttagtattgatatgtgcagatttgatcctgtcattgtatttttagccagtttctatgcagatttgattgtgtggttgcttcacggtatcaatgttttacgtacataattgtgtttttgtagcgtcaggtaatgatcttttcataaatagaactcctttaagggcctcttatagggcagttttcctggtaacaaattccctgagcacttcctggtctgaaaagactctgatctcttctttacttatgaagcttagtttggctggatataaaattcttggttgtatttttttgttgttgttgttattaatgctgaatatatacccccaaccttttctggcttgtaagatttctgctgaaaattccactgttagcctgatgggttttcttttgtaggtaacctgacccttctctctagctgcctttaacatttttttctttcatttccactttggggaatctgatgactatttgtcttggggatgttcttcttgtggagtatttcactggggcaatctgtatttttctaaatttaaatgttggcctttttagtgaggatagaaaactttccatggatgatattctcaaatatgttttccaagttgtttgatttctctccctgtttttctggaatgccaattttcatagagttggtctctttacataattccatatttctcagaagttttgttcattcttgtttgttgtttttctttacttttgcctaagttatttcagaaaaactgtcttggaaatctcagattctttcttcagatttgttgattctgctgttaggacttgggttgtgttctaaaattcctgaagtgagtttttcaattctatcagttccattttattcttcttctttttttaattttattgttttaatgggcacataagaattgtaaatatttatgtggtacattgtgacttcatttattttattttattttattttactttaagttctgggattcatgtgcagaatatgtaggtttgttacataggtatacatataccatggtggtttgccacacctatcaacctgtcatctaggttttaagcccggcatgcattagatatttgtcctaatgctctccctccccttgccccccacctcccagacaggtctcagtgtgtgatgttcccctccctgtgtccatgtgttctcattgttcagctcctacttatgagtgagaatatgtggtgtttggttttctgttcctgtgttagtttgctgagaatgatggcttttagcttcatccatgtccctgcaaaagacatgaactcattttttatggctgcatagtattccatggtgtatatataccacattttctttatccagtctatcattgatgggcatttgggttggttccaagtctttcctattgtaaatagtgttgcaatgaaaatacctgtgcatgtgtctttataatagaatgatttataatcatttggatatataagcagtaatggcattgctgggtcaaatggtatttctagttctagatccttgaggaattgccccactggcttccacaatggttgaactaatttgcctttccaccaacagtgtaaaagcattcctaaatctccacatccttgccagcatctgtcgtttcctgactttttaatgattaccattctaactggcatgggatggtatctcattgtggtttttatttgcatttctctaatgaccagtgatgatgagctttttttcatgacagattgcaaaatttctctcccattctgtaggttttctgttcactctgatgctagtttcttttgctgtgcagaaggtctttagtttaattatatttcatttgttaattttggctttagttgccattgcttttggtgttttagtcatgaaggctttgcctatgcctctgtcttgaatggtattgctcaggttttcttctagcattttcatggttttgggttttatatttaagtctttaatccatcttgagttaatttttgtataaggtgtaaggaaggggtctagtttgtgttttctacatatggctagcttgttttcccaacaccatttattaaatagggaatcctttctccattgcttgctttcagcctgccctacaagaactcctgaaggaagcactaaatatgaaaaggaaaaactggtaccagctactttaaaaacacaccaaaacttaaaccccaatgacactatgaagaagctgtctcaactaatgtgcaaaataaccagctaacatcacaatgacaggatcaaatacacacaccacaatattaatcttaaatgtaaatgggttaaatgtcccaattaaaagacacagcctggcaaattgaatacagtcaggaccaattggcgtgttgtattcaggagacccatctcacgtgcaaagaccaacataggctcaaattaaaggaatggaagaatatctaccaaacaaatagaaaaaaaaaaaggaaaaaaaaaggcagaggttgcaatcctagtctccgataaaacagactttaaaccaacaaagatcaaaaaagacagaaaagggcattacataatggtaaagggatcaatgcagcaaaaagagctaacaatcctaaaaatatatgcacccaatacacaagcacccaggttcataaagcaaattcttagagacctacaaagagacttaaactcccacacaatactcatgggatactttaacaccccaatgtcagtataagacagatcaataagacagaaaattaacaagggtcttcaggtcttgaactcagctctggaccaagtggacctaatagacatctacagaactctccaccccaaatcaatagaatatacattcttcttaccaccacattgcatttattctaaaatcgaccccacagttggaagcaaaacactcctcagcaaatgcaaaagaacagaaatcataacaagcagtctctcagacgacactgcaatcaaattagaactcaggattaagaaactcactcaaaactgcacaaatacatggaaattgaacctggttctgaatgactactgggtaaataagaaaattaaggcagaaataaaaaagttctttaaaaccaatgagaacaaagagacaatgtgtcagaattttttggacattgctacaacattgttaagagggaaatttatagcactacaaggtctgcaacagaaagctgggaagatctacaattgacatcttaacatcacaattaaaagcactagagaagcaagaggaaacaaattcaaatgctagcagaagacaataaataactaacatcagagaagaactgagggagatacagacacgaaaaacccttcaaaagatcaatgaatccaggagatgaatttttcaaaagactaacaaaatagatggaccactaggtagactaacaagaaaagagagaagaataaaatagactcaataaaaaacgataaagggaatatcaccactaatcccacagaaatacaaactaccatcagagaatactataaacacctctatgcaaataaactagaaaatctagaagaaacggataaattcctggaggcatacactctctcaagactaaaccaggaagaagccgaatccctgaatagaccaataacaagttctgaaattgaggcagtaattaatagcctaccaaccaaaaaaaaaccctggaccagacagatacacagctgaattctaccagaggtacaaataggagctggtgccattgatattttcatatggattgcattgaatctgtagatgactttgagtagtatgaacactttaacattgtttattcttccaatccatgaacatgaaattttttttatatcttgtgtgttcagtttctttcatcagtatttcatcagtgtttcatagttctcattttagagaactcacttcagttaatttgtaggcatttagtttcatttgtggctattttaaacgagattactgctttttattttttgtgtatgtgctcattgttcacatatagaaatgctactgattttttgcatgctgattttgcatcgtgcaactttactgaatttgtttatcagttctaatagtgttttggtgaagtctttaagtttgtccaaatataagaccacatcatatgcaagcaaggattatttgagttctttctttctaatttggatgtcctttatttctttctcttgtccaattgatctagctaagacttccaataatatattgaataatagaggtgaaactttgcatccttgatgtgttccagctcttataggaaaggctttcatttttttttctatttagtataataccagcattgggtctgtcatatatagcttttatgtgttgaggtatattctttttaaacccagtttttttagggtttttatcatgaagacatgccaaattttatcaaatgtttttcagcattaattggaatggtcatatggttttgtccttaaatgtgttgatatgatttatcacattgattgatttacatatgttgagccatccttgagtcccagagataaatcacatttggtcatgatgaatgatctttctaatgtattgtagacacttgtttgctagtatttcgttgagaatttttgcatcaatattcatcagaaatattggcatacagctttccttttagatgtgtctttatttttggttttgatatcatagtaatactaggcttgctgaataagtttggaaatatacctttctcatctatttttcagaatagttttattcctctttaaatatttgtggaagtcagcagtgaagccattgggtcctgggcttttctttactgggagactttattatggcttcaatcttgttattattattggtctgtttgggttttggatttcttcatgtttcagtcctggtactttctatgtgtttaggaatttattcattttttctagattttccaatttattggcatataatttctcgtagcagtcacttatcatcctttaaatgtttgtggtatcagttgcaatgtctctgttttcacctctggttttatttacttgagtctactcctttttaagtagttaatctgactagaggtttgtctatttttaaaagtctctttaaaaaaccaacatttcattttattgatctttctattgttttctttattgaattttatttatttatgcttgatattttaaatttcttttcttctattaattttaggtttggttttctattgattttctagttctttaaagcatgttaataggttgtttatttgaatttttttgatataggtttttatagctataaatttctctcttagtactgctttcactgtatcccacaggttttggtatgttgtgtttttattatcatttatttaaagaattttaaaaatttctttcttaatgtattcattgatccactgtacattcaggagcatactgttcaatttccttgtgtttgtatagcttccaaactgtctcctgttattgatttgtagttttattccattgtggtcagaggaagtgcttcatatttttaaaaatttttttcaatgttttaagacttgttttttcatatggtcttccactgagattgatccatgtactgaggtgtagaatgtatattctgcagtgttggataaaatgctctgtaaatatctagtaagtgcatttgttctgaagtgcagattaagtccaatgtttatttatatattttctgtctggaagacctgtccactgctgaaagtggcatgcttaagtctctagttattgtattgtgattatttttctctatatgtctaataatatttccttcaaacatctgagtgttcaagcattggataatatatatttacaattgttataaccttttgctgaattgacacttttatcactatgtaatgacttgtttgtctcttattacagtatttgttttgaaatgtattttctctggtatagtatagctatttctgctcttttttggttttcaatggcatagaatatattttttcatctttttattttcaatttatgtgtatctttataggcgaattgtgtttactgtttgctagaaattattgggtcttttttttaaaaatccattcagacattttatctcgattgattactttagtccttttacgttaaatgttattaataactaagaactttcccctgccaatttgttttttgttttctggctgttttgtactttttttcttccttcctgtcttccttttattaaaggtgagttcctttcatgatgtgatttaatcatctcttgtttttattttttgtgtatatattgtatattttgatttgaggttgccatgaggcttgcaaacactatcttataacccgttgttctgaacagatgacaacttaacactgattgcataaacaaaaaagcagaaagaaacctaataaatactctattttaaccccatttccaagctttttaactttttgctatttctctttatgttttattataccatgtatatgtattgaaaaactgttgttatacactacaattacagtgttataacattctgtgtttttctctgtgctcttacaagtgagatttgtactgtctgatgatttcttcttgttcattaacattctttactttcagattcaagaactccttttagcattccttaataggataggtctggtgttgataaaatcccatagcttttgtttgcctggcaaagtctttatttctccttcatgcttgaaggatattttcaccatatacttaaacttcttatgcttgcatgttgatgtatttctgtaggtttgagaaattctctgatattattactttgaattaactttctacccctatctttttctctacttcctctttaagaccaataactcttagatatgcccttttgagactattttctagatcttgtagtcttgctttttttaaaaaaaatgccattttcttttgtctccactgagtattttcaaacagcctgtgtttaagctaacaaattctttgttctgcttgatcagttctgctataaacggactctgggaaagggtgccaagatggccgattagcagcaactgtggttcatggcactcatggtgaggaatgaaagggaagagtgaatacagcaccttcaactgaaatatccaggttctcagatggggaatgattagggaaacaatttgacacacggagaaggaataaaaacagagtgggatgatggcccacctgggagtaacatggagccaagggaacccacacctccagccaagggaagtggtatgggagaaactgaggcaactaggctctggagtagatctccagcaaaccgaagcagccctacagaagagtggccagactgttaaaaagaaaaacaagcaaacagaaaacaacaacaacaaacacaaaaccccatcaaaaatcagcaaccttgaagatcaaaggtatataagcccataaatacgagaaagaaccaatgcaaaaacactgaaaactcaaaaagccagagtgcctcttttcctccagatcacaacaatacctctctgtcaagggctcagaacaaagctgaggctgagatggctgaaatgacagaagtaggtttcagaaggtcggtaatactgaactttcttgagctaaaggaacatgtagtaacccaatgcaaagaagttaagaattatgataaaacaatacaggagctgaaagccaaaataaccagtttaaaaaggaccataactgacctgttagagctgaaaaacacactacaagaacttcacaatgcaatcacaagtattaatgacagaatagaccaagtagaggaaagaatttctgagattgaagcctatctatctttctgcaataagacaagtggacaagagtagacaaaaaagaatgaaaaataataaagaaaaagtccaagaaatatgagattatgtaaagagactgaatgtaagactgattagggtacctgaaatagatagggagaatggaatcaagttggaaaacatacttcaagatatcatgcaagagaacttcccccatgtatcaagacaggacagtgttcacgttcagaaaatgcagagaacctcaggaagatactccatgagaagataattcccaaaactcatattcttcagattcacaaaggtctaaatgaaataaaaaatattaagggcagccaaagagaaaggccaggtcacctacaaagtgaagcccatcagactaacagtgggcatctcagtgagaactcttcaagctagaagagatcgaaagcttaatatttaatattcttaaagaaaagaattttcagcccagaatttcatatccaggcaaactaatcttcataagtgaaagagaaatatggtcctgttcagagaagcaaatgctgagggaattcgttaccatcagacttgccttacaaaagctcctgaaggaagcagtaaatatggaaagaaatacctattaccagccacttcaaaaacacactgaagtacacagatcagtgacactatgaagaaacacataaacaagtttgaaaaataacctgctaacatcatgatgacaggatcacatctacacataacaatactaatcttaaatataaattaactaaatgtcctaattgaaagacacaaagtgggaagaaggacattacaaaatgggaaagggttcaattaaataataagaattaactatcctaagtgcaaatgcacccaatgcaggagcacccagatttgtaaagcaagttcttagagaccttcaaagagacttagacacccacacaataaaagtgagactttaataccccactgacaatattagacagattatctattcacaatagcaaagacttagaaccaacccaaatgtccaacaatgacagactgaattaagaaaatgtggcacatatacaccatagaatactatgcagccataaaaaatgatgaattcatgtactttgtagggacatggatgaaactggaaatcatcattctcagtaaactatcacaagaacagaaaaccaaacaccgcatattctcactcataggtgggaattgaacaatgagaacacgtggacacaggaaggggaacatcacactctggggactgttgtggggtggggggaggggggtgggatagcattgggagatatacctaatgctagatgacgagttagtgagtgcagcgcaacagcatggcacatgtatacatatgtaactaacctgcacattgtgcacatgtaccctaaaacttaagtataataataataaataaataaataaaaataaaatcaacaaagacatacaaggcttcaactcagcttgggatcaagtggacctaatcaatatatacaaaactctctaccgcaaagcagaatatatgttcttctcatcaccacacaacacttactctaaaattgatcccataattggaagcaaaagtctcctcagcaaatgcaacagaactaaaattataacaaacagtccctcagaccaagcacaaattagaaatcaagattttaaaatgtactaaaaaccacacaactacatggaaactggacagcctactcctgaatgactcctgggcaaataataaggcagaaatcaagaagttctttgaaagtagtgagaacagagagacaatgtaccagaatctctgggatgcagttaaagcagtgttaagagggaaatttgtaggactaaatgcctataacaaaaaactacaaagatctcaagttaacaggctaacattacaactaaaagaactagagaaacaagagcaaacaaaccccaaagctaacaaaaaacaatacttaaccaagatcagagctgaactgaaaaagatagaaacacaaaaaacacttcagaaaattaatgaatccaggagctgtttttctgaaaaaaattaataaaatagattggccactagctagactaataaagaagaaaagcagggtgaaaccattgctccaccttgcttttctttcttatgcgtatgtcaagttgtttccctactcatttccaatgcaagattcatatatttcagttgaaggtgctgtattcactttcccctttcattgctgtccatgagaagattcaaataaacacaatcaggaatgataaaggtgatatcaccactgaccccatagaaatacaaacaaccatcagagaatactataaacacttctatttacataaactggaaaatctagaagaagtgaatagttcctggacacatacaccctctgaagactgaacaagaatgaaactgaatctctgaatacaccagtaacaagttctgaaattgaggcagtaacaaatagcctaccagcaaaaaaaaaaaaaaaaaaaaaaaaaggcagcctaggaccagatggattcacagttgaattctactagaggtacaaagaggagctggtaccatttctactgaaactatttcaaaacattgaaaaggagggattcctccctaactcattcattgaggccaacatcacccgataccaaaacctggcagagatatgacaaacacaaaaacttcagggcaatatgattgatgaacatcgatgcaataatcctcaacaaaatactagcaaactggatccagcagcacatcagaaagcttatctactatgatcgagtaggcttcatccctgggatgcaaggtgtgttaaatatatgcaaatcaataaacgtgattcatcacataaacagaggtaaagacaaaaaccacatgattatttcaaaagatgcagaaaaggcctttatttatttatttatttcccatttccataggatactgggtcacaggcagtgtttacttacataagtaagttctttagttttgacttgtgtttttggtgcacccatcacccgagcagtatacactgcactttttgtagtcttttatccctcaccccattcccaccctttccaccagagtccctaaagtccattttgacattcttatgtctttgcattatcatagcttatctcccacataccagtgagaatgtatgatgtttggttttccattccagagttacttcactaagaataatagtctccaatctcatcgaggtcactgtgaatgccagtaatttattccttttcatggctgagtagtattccatagcataaatatataccacagtttctttatccaatcattgattgatacacatatgggttggttccatggttttgcaattccaaatcgggctgctataaacgtgtgtgtgcaagtatcctttctttttttttaacggaaataccatgtgcttaatttaatttatcattgaatataaggcactactctaagaagtgaaaagaaactcatagctcctcatgtcattatgaaataagtattattggcctcatcctcattttacagagcagaaaacgggaaaaggagataaactgattttttgtaaggccaaaagagaattatatgagcttgaggttgaagccaggtagtctacctgagtacatttccttagcccatgctataatccctctgctatagtgtgctgcttaactggctcactcatctataaaaaattttcaaatcaatcttggactaaaattcagttttagataacaaatcaagtaaaactcatcaaacattattttaccctgtaatataaagttgaagcacttattcttcaatttctctttctgcttatcaaaaaaatccctggctaaacattgaacaaaatcaaaactggtgaataaaattattattatcattttaaacaaataacttttttattattatacattaagttctgggatacatgttcagaacgtgcaggtttgttacataggtatacatgtgccaaggtggtttgctgcacccatcaacccgtcatctatagtaggtatttctcctaatactatctctcctctagcctccccaccccctgacaggcccttgtgtgtgatgcccctacctctgtatccatgtgttctcattattcagcttccatttatgagtgagaacatgcggtgtttggatttctgttcctgtgttaatttgctgggaatgatgattcccagcttcatccatgtccctgcaaataacatgaactcatcctttttatggctgcatagtattccatagtgcatatgtggcacattttatttatccagtctatcattgatgggcatttggattggtttcaagtctttgctattgtgaacagtgctgcaataaacatatgtgtgcatgtatctttatagtagaataatttaaaaccctttgggtacatacccagtaatgggatggctggatcaaatgctatttctggttctagatccctgacgaattgccacactgtcttccacaatggttgaattaatttacactcccatcaacagtgtaaaagagttcctatttttccatatcctcaccagcacctgttgtttcgtgactttttaatgatcgccattctaacaggcgtgagatggtatctcattgtggttttgatttgcatttctctaatgaccagtgatgatggctttttttcatgtttgttggctgcataaatatcttcttttgagaagtatctcttcatatccttcgcccactttttaatgttttttttcttgtaaatgtgttgaagttccttgtagattctggatattagcccattgtcagatggatagattgcaaaaattttcacccattctataggttgcctgttcactctaatgatagtttcttttgctgtgcagaagctctttagttaaattagatcccatttgtcaattttggtttttgttgccattgcttttggcattttagtcattaagtctttgccaatgcctatgtcccgaatggtattgcctagattttcttctagggtttttatggttttaggtcttacatttatatttaaatctttaatccatcttgagttaatttttgtataaggtgtaaggaaggggtccaatttcagttttttgcatttggctagccagttttttcaacatcatttattaaatagggaatcctttccccattgcttgtttttgtcaggtttgtcaaagatcagatggctgtagatgtgtggcagtatttctgaggcctctgttgtgttccattggtctatatatgtgttttggtagcagtatcatgctgttttggttactgtagccttgtagtattgtttgaagtcaggtagtgtgatgcctccagctttgttatttgtgcttaggattgtcttagctatacatgcccttttttggtcccatatgaaatttaaagtatttttttctatttctgtgaagagagtcaatggtagcttgatggggatagccttgaatctataaattattttgggcagtatggctattttcatgatattgattcttcctatccatgagcatggaatgtttttccccttgtttttgtcctctcttatttccttgagcagtggcttgtagttctccttaaagaggtccttcgcataccttgtaagttggattcctaggtattttattctctttgtagcaattgtgaatgggagttcactcatgatttggctttctgtttgtctagaaatgctggtgatttttacacgttgattttgtatcctgagacttcgctgaagttgcttatcagcttaagattttagactgagatgatggggtttttaaaatatacaatcatgtcatctgcaagcagagacaatttgacttcctttcttcctatttgaatgccctttatttctttctgtttcctgatttcccttgccagaacttccaaaactatgttgaataggaatgttgagagagggcatccttctcttgtgccagttttcaaagggaatgcttccagcttttgcccattctgtatgatattggctgtggttttttataaatatttttattagtttgaaatacgttccatcaatacctagtttactgagagtctttagcatgaaagagtgttgaattgtatcaaaggccttttttgcctctattgagataatcatgtggtttttgtcattggttctgtaacgtgatggattatgtttattgatttgcgtatgctgtacaagccttgcatcccagggatgaagccaacttgattgtggtgcataagcttcttgatatgctgctggatttggttggccagtattttattgaggatttttgcattgatgttcatcagggacattggcctgaaattttctttgttttgtctctgcctggatttggtatcagaatgatgctgtcctcataaaatgagttaggaaggattcccttttttttttttctattgtttggaatagtttcagaaggattgttacaagctcctctttgtacctctggtagaatttggctgtgaatccgtctggtcctgggctttattttggttggtaggctattaattactgcctcaatttcagagcttgttattggtctatttagggattcgacttcttcctggtttagacttcggagagtgtatgtgtttatgtgtttatccatttattctatattttctagtttatttgcacagaggtgtttacagtattctctgatggtagtttgtatttctgtgagataagtggtgatatcacctttatcattttttattgtgtctatttgattcttctctcttttcttctttattaatctggctagaggtctatctattttgctaatctttttaaaaaaaaaaacagctcctggattcattgattttttgaagagttttttcatgttcctgtctccttcatttctgctctgatcttagtgttttacttccaactatgtggtcaattttaaaataagtgcagtctggtgctgagaagaatgtatattctgttgatttgggatggagagttctggagaactctattaggtccagttggtccagagctgagttcaagtcctgaatatacttgttaattttctgtcttattgatttgtctaatattgacatgtgttgttaaggtcttccactattattggtgggtgtctaagtctctttaaaggtctctaaggacttgctttataaatctggttgctcctgtattgggtacatatatatttaggatagttagctcttcttgttgcattaatccctttaccattgtgcaatgcctttttttgtgtgtgttttctgacctgtagaagtgttccctattcactgcatgcacgccaacatctaatttttgattttttgattgtggacttgcatgaataagttgttatcacattgtggttttgatttgcattttcctgatcattagtcatgtttagcttttttatgctttttggacaattatatatcttcttttaagaattgtctgctcatgtccttaacacgctttttgatgggattgtttgtttgtttctggatgatttgtttgaattccttgtggattctggatatcagtcctttgttagatgtatagattgtgaagattttctgccactctgctcgctgtttcttttgccatgcacaactggcatggcagtttaaactaaactaaagtttaattaaattccagccatttatcttttttttgttgttgttgttgtttttcttttttggggggaggggggttttggtcataaaatccttgcccaagccaatgtttagaggggtttttccagtgttatcttctaaactttttacagtttcaagtattaaatttaagtccttaattcatcttgagttgatttttatataacgtgagaggtgatgacccagtttcattctcctacatgtggcttgccaattatcccagcacatttgttgaaaagggtgtcctttccccagattatgtttttgtttgcttgtcaaagttcagttggctgtatttgggtttatttctgagttctctattctgttccattggtctatgtgcctgtttttataccagtaccatgctgtttttttgactatagccttattgtatagtttaaaatcagggcatgtaatgcctccagatttgttctttttgcttagtctttctttggctatgctatctctctattggttccatatgaattttagaaatttttttgaattctgtgaagaacgatggttgtattttgatgagagttacattgaatttgtagcttccttttggcagtatggtcattttcacaatatcgagtatacccatccatgagaatgggatgtttctatttgtttgtgtcgtctatgatttatttcagcagtgttgtgtagttttccttgcagaggtattttgtctccatggttgtgtatatcctaagtatttaaattttttttgcagctattgtaaaaagggttgaattcttgatttgagtctcagcctggtcgctgttggtgtatagaagagctactgatttgtctacctttgttttatattgggaaactttgctgtattcttttatcagttctaggagcattctggaggaatctttagagttttaaaagtaaagaatcatattttcagcaaacattgacagtgttagtttctttttactggcatggatgccctttatttcttttggttttctgatttttctggccaggagttccagtgctatgttgaagaggagtggtgagagtaggcatccttgttttgttccagttctcagagggaaggctttcaacttttccccattcagtattatgttggctgtgggtttgtcatagatggctattattaccttgaggtatgttccttgtaagccaattttgatgagacttttaatcataaagggaagctggactttgtcaaatcctttttctgcatctgttgagatgttcatgtgatttttgtttttaattctgtttatgtgttgtatcacatttattgactagcgtacgttaaaccatccctgcatccttggtatgaaacccacttgatcatggttgattatcttttttatttgttgttggatttagttagctagtattttgttaaggattttagaatctatgtttatcagggatattggtctgtagttttcttttttgattatgtcctttcttggttttggtattagggagatgctagtttcatagaatgatatcatgagggttccctctttctctatattgtggaatactgtcagtaggattggtaccaattattctttaaatgtctggtagaattctactgtggatctgtctggtcctggactttttttgttgataatttttaaattgccatttcaatcttgcatctagttagcggtctgttcagggtatctaattcttcctgatttaagctaggagagttgtatctttccaggtatttatctatctcttctaggttttctatttatatatgcataaaggtgttcatagtagccttgaatgatattttgtatttctgggatgtcagttgtattatctcccattttatatcttattgagcttatttggattttctttcttcatttcttggatatccttgctaatggtctatcaattttatcttctcaaaaaaaccagctttttgtttcaattttcttgtatattgtgttttttgcttgtttatttaattttatttagttctgatcttatcttggttacttttttcttctgttgggtttggatttggtttgttcttgttctgtagttctttgaggtctggccttagattttctgtttgtgctctctcagactttttgatgtaagcctgtaggactataaactttcttcttagcaccacctttgccatatcccggaggttttgataggttgtgtcactattgtagttaatttagaagaattttctaatttccatcttaattttattcttgacccaatgctcacgcaggaacaggttatttaatttccacgtatttgcatggttttgaaggttcattttggagttgatttccagatttattttactgtggtcttagagaatgcttgatataatttcaattttcttaaatttattgaggctcactttgtggcctattatatggtttatcttggagaaagttccatgcgttgtttaatagaatatgtattctgtggttgttggatgaaatgttctgtatatatttgttaattccatttgttctaagatgtagtttaaatccattgtttctttgttgacttactctcttgatgacctgtctagtgctgtcagtggagtactaaagtcccccactcttactgtgttgttgtctatctcatttcttacgtctattagtaattgttttataaatttgggatctccagtgttatttgcatatatgtttagaattgtgatattttcctatttgatgagggcttttatcattttataatgttcctctttgtctttttaactgcttttgctttaaagtttgtttcgtatgatataagaatagctactcctgcttgcttttggcagcagatagttggttagtgaattcttatccactctgcaattctgtaccttttaagtagagcatttaagctatttacatttaatgttagtactgagatatgaggtaccattctattcatcaggctatttgttgcctctataccttggttttttgtttgttttggttttttaaattgtatttttgtttcataggtcctgttaaattcatgctttaaaaaagttatgctttgatgtgtttccaggatttgcttcaatatttacagctgtttttagcagttcttgtagtgctggcttggtagtggcaaattctctcagcatttgtttgtctgaaaaagtctgtatctgtccttcatttatgaatcttattttcacaggatacaaaattattggcagataattgttttgctttaggagactgaagatagggccttaatcctttttagctagtagggtttctgctgagaaatatactgttaatccgatagcttttcctttataggttacctggtgtttttgtctcacagctcttaagattcttaccttcttcttaactttagattacctgatgacagtgtgtctagttgatgatcttttggtgatgaatttcccaggtgttatttgtgcttcttgtatttggatgtctaggtctctagcaaggctggtgaagttttcctcaattattcctccaaataagcttttcaaacttttagatttctcttcttcctcagaaatgccaattattcttagatttagtcatttcacataatcccagacttcttagaggctttgttcatattttcttatatattttttgtctttgttggattgggttaattcaaagaccttgtcttggagctctgaatttcttttttctacttgtttgattctattgctgagactttcttgagcattttgcatttttataagtgcaataactgattttatataactgattttataataactgattttataataactgatgatattttgacactagtatgtgattttggaaactcctagggagactgtctgatgtagttttccaagctgaacactatgagggactcaaggggataaacatcctcttttttgaggcctgtcttaaggaggcatctgtggtgtagtggacagtgctgggcctcagagtcacagtcttgggctgaaattcagcatatcacttgctgctgtatattcacagaaaaattattaaacctttgtgaactttagtttcttcttttgttaaataaagattgtaaaaaatgcctaccacctaggaatatcatgagtattaaataagacaaagtatggaagtaaaaaagcacaccagcaataatcactaaatattagtttttcatccaccttctctttcactgcactactccttagaaaggaggtcttaaggaaggtaatttgctctcactagaaaccacaaggaagaaaggctttgtagaagataaccatgtgactgcacagctgccctcagtggggatccattttatctggacaggcagcaggtgaacccctaacactcatgtgtacacaatttctgaggacttaaaagcctaactgctgggtacatagaaacttgccaatcacactgtgagcataaaatgcagtagcatcataccagcccagaaatatgcaagtgattttagtccctaatgaaaaggttattaacaatcacctaagaatcttgtctgacagtttgatgacttgtttgctgctttgatccatctattcccagagatctggttccccatgtccttctggggtatacagtgggggctcactgccctttgactgacacaggcacacacaaatcaactccaaaacagagaagtgttgcctaaatgctaacccttcctatgcctttatcatcatccataaatcagaggattctgtttcccccactgtaccaccattcataattttatcaagtgagaatgcaaggcccagttaggatttaaaaaatgccttttctcaaatagaggcatgataaatacacaagttctggcctcttacctcctggtaattccagtcacttctcccccattctgtagtggttccctcaataagcccttctacagcctgtgatagttatttcccaatatatcttttcctatgcacacccctaagccttagtggtttcctccgtcctttctcctttggtatgagtgatacctcctaaatcgtcctcctctaagttctgcctagatgttttctctccctcttttctctaggctacatagggtctagagagactaaaaagaagagaacggaaaaggactcaagttctgtctctttcttttgctctgaactgagcaattaagttgtgagtgtgtgtgtgtgtgtgtgtgtgtgtgtgtgtgagagagagagagagattggttatggaatcagccctagtaatgaacatttttaagaaagtaaattagtaaaccaatagcagtctactcagagatcagagatcagtaatcatagaatatttttaaaacagctttattgaggaatattctaaatattataaaattcattcataatttcatgtatacaagtcaatgatttttattaactttattgagtggggaagacatcagcataactaaatcttagaacatctttatcctttaaataagatccatcatgcctattaacatttaattgtttttctcatgcccattccaaggcaaccattaatctacattctgtcttgattagcatgctttttatggatattttatatagatggaatcatacaatatgtggtctcttgtatctgacttattttacttgacatgatttaaggttcatctacaatgtattatgtgtcagaagttcaatattgtttattactgaatagtattctattatatgtatataccacaactttttatctgttcatcagttgatggacatttgggttgtttccacttttcggatattataaataatgtttctatatttgtatacaagtattgtgtgtacatatgtttttaattatattgagtatatatctaggagtgatattactggatcatactcaagtttagcttttagagaaactgtcagactgttttgaaaagaggctataccattttataattctaccagcaatacatgaggcttctcatttctccacatccttgccaacatgtattgttgtaaagattacagaatattaaagatggaaggaaacttgattttcctatctcttaaattaaattatagtaaagtatagcattcaaaattaaatagtttctctttaggtggtctctttaacctggtaagattatcaacacaaatacagaccttgaaatggcaaggcagtactcttaacaggtctagctagaatatgcttgtattttaagacattatgatcaaaatgaaaacacacacacacactgaaattcctaaagattttgcagacctcagaagatgtgcagtgcacggttcccttaggaccatggaaccctgtttgataagtattagtttagaacacaacaatttctagtagatccttatctcagaggagaatataaatggcataaacaattttagaaaaagaaagagagcttgaactataacccagatctcctgtgtgacaagtcagtgaatcccatcactactgatgccatgtccaatgatcagaaacacatttttttgctgtgctcactaagaaaagacacatgagcaaaatgattcaccaggttctctgaaagtagaggaataaacaaggtttttggatatatttctgtttattggccaatatgaaatgtttgcagagcatcataaacaaacatagccctgccagtatctacacatgcatatggctcaagagttaacaaaatttctataaataacccatttatgagaaaaaataattaaaatgtaccaatattcaatgtaaaacactgaagacctagctagtagggtggggttggtagagaggagtgggacaggagggattatgatctcaatgtgacagggctgtatgttgtagaggggtatgctgtagtgctgaatcctttcctaacctggatctgagaatcttggaggaaaaaattattttcccaggctccctcctgtcaaaatccaagtcaaggtatatggagagaaaaacagtaatccaaaaaaaaaaaaattcattctcaggaaatacctccccttccttacaaacaaaaactacattttttttttttgctagttcatttagagacaacttaactgctgtttaggctcaatgtatgttgaaaatgtttttatcaagtgtactttgttcttccactgaccaataacccctttgtagaaagacacataaaagcacagtgctcaaagaaatatgcctcagcattgaaaagtaaaactgtaaaaagaactctcctgaagcaaatactcaactatggtatttgccatggccaaacagaaattataaagacgaaaatccttcacttcacctttacccgaaatactttaaaatgcaaagccaattgccacctccaattgctgaacctcaaaaagttggaattaaggtgattctgggtatggcttgggctgtccacatagcattcatgccatgagcaagcacactgaagaagtcttactctttcactttatcatatttttgttattattattattattactgtgttaccatcattatctttcctctagagcagcagtgtcaaatgtgggcttgaaccactgccagccacatggcaacctttgaacacctgcagcctgctgaagccaaatcatcccctgtctggatattatttcttctaccagaaggtctaaacatgatcagtgaaagccagtgagataagaataacctgttgcagaaaaacaaaaacaaaaacaaaaacaaaaaaaaaacaggaaacctaaaggccaaggcctaaaaccttggttaccacatatttgctaatacctgtgtggggccaggctgcttgcttggtacaggcttgtatttcaattgcttctaatcctcagtccagtacaatgggacctttttgctttttcccaagtccttttagtaatctgatcaattggttgccccaggggcccttaatcagtgtttgtagatggatgaacccaaaagatgtagttaataaaattctaaaagcaaaaatcttgctgtagacagcactcctttgccagagctagaacctggtgatgaagtgcacattctgcctaatgtacttaataaaccacttaatagttgtgggacaggaactagctgtacaagtttcagacagattcttggagaataaagaatacaacctctaaggaacttgtttttctctgagcatgagatgtataggtgggagctaaaggcaaaaagacaattgagaaagaatcaaaggggaacggtggtgagaaagctgggattgaattgacatttcaatagaaagaggcatactcagatgtccctacatggattgagggctgtctttgagggactgctgtggggtagtttggggaactcaggccccagaaggaagattactttggctcagaaatgttctgtaaggttccaaaatggcgaacttcagcccttctccctgctgagggtggtgagaacctcaaatacagggtgaggccccagggatctagagggaaagtgtttgccctgcctcatgctgcaatgcagcagtctgagacatgaacttgggaattatggcacgaggcctcccccaagatagatattaatgtgtgtgtgtgtgtttgtgtgtctatgtatatgtgtgtgtatgtgtgtgtgtgtgtgttgaggagggagacagtgtggaggagctaaaaggggagaagggtttgattttgtccctaaagtgctaggtagatgtgccaacacaattttgagaggcttacctgaccaaaaatgcagacatgaaaaccctaccccattcactgtcctctctcctcttctctataatcaagttgagctaggaacatgtctggtagtcccatgaatgtggaatctggctccccagactacaaaagggaagcaagaaatgctccagatcagtccttgtgaaatggagaatcaatcctctggtgggatgggataggatatgccccatctgtagggtattagctcttgtggacatcacatttcaggcccctgctgctgttgtggtataggaacagagtccagagagaacaactgggcaaggctgccaggggcccaagagacctaaggagagagcaaaccaagttagaaacatgtggggaaatctcactagcacccttctttctctacccctccaaatatcataggttaagccaatggttgaggatgtaatagcagaaagacattacctagatagggatatgacaattctaccctattctacattgttgaaaccatttatcctgaagataggtttagttctaagctccacatactttagaagaacctaaagtggtattctccagagaggtggtgttgtcttcaagcctctgcagggctatcttaaagcagaggaaactgatgaggtctgtctggcacgaggaacagagccaggatggataggcgggtactacagggaaagctctttcttacattgagctcaaacccaccagtcacaattgtgtatactgtaatatacattgagaagtagtcagccctctgccacctaaagtatgtgagcaaggactacacaaactcttagtggggatattataaaatggacccaaaccttggaagaagaactggactagataaccttgaaggtacctaagttgattgatttgacatcagttataactttcaaatttgatatcagttatgactttcaaatatacatttgttcacgttttcttaggttggatgcagggagcagggaagtcattgggagaactgaaaatgtattaactgaagaaatacggaagtgggcactgcaagatatttggttagttgaaaactgggaatctacctactctcctacctcatgctacataagctttgagaaagtaacattggctatcaaatggttgcaatggtggagttgaaccaactctaaaatgtagcccccaaacctgggttcttgcacagttctagcccactaatttgccctgtgactttgagaaactaactttccctctctgtgtctcagttcctgcctctgtaaaatgtaaaatgaagtgacatacacacaaggtttgtatagttattagggaatgaaggttgatttgaaatgtagggtttccagatgacaaggcttgtatatctttttctactgtgctatgctgcttgcacacataaagggagatacctgaatatgaccattagatagtggggccctgagagagcttacgaaagaccagaatggagagactggtatcatgacaaccttgccagttccctgacaattgtagacccagaagtgtgatatctgtctggcttaaaagtttagcatcaccactgttgcccctccacccaaagtgttcctagcttgctgctgttcctccactcctagtgaataatactattccaaaagagaattccttgaggttagtccttaatttctgttttgctttttttgtttttttctgatccacctttccagctcacctcattagagttaagggctgggaacttcaaagggcacattgagctccagcctgtctccagtgctttcgactgtgtttccccccaaggtctcagctccagtataggaggcagagctggaaaacttttgcaggtccagctctgtgcattcgatggggctgtggacccagtgggagtggctctctgaggtgcaggaggccatggtaaaggactcctgtgtggggaagccactagtcgagctgcagtcgtcctcgaggatagggttaagtggctgggtctgaaagatgttctcactcacttgggactcagcactggtctccttgctgggtggcacggggaagagagattcctcctttgctgttttatcagcctcaaactgcagcaaacctcctgcaactcgaagcagaaagccactgggttacccaaaagcaggggctcttctcagctgggcactgggtactgagtacaagacaggtaaaggtctgggagctgattctttccttcctctccctggggtctagagcacctagcaccaggctgaggtgacacagttgagaaacatacttacattcaggtatcagattgaggctagctggtactggatcagagaaaataatcaatttctctagagaaaaagaaacctttgtgggaaacaggattttgataccatctcccttgccataatcttcatggcctggtcttatgtctatgtacattaagttacatggcaaactagactctgcagatggaattaaagttatggatttcaaaataaggagagaatcctggattactctatgggtccaatgtaatcctgtgtccctaaaagcagaagaggaaggcagaggagacagagagtatcagagagatgtggcatgagaagaactcaactcatcattgctagttttgaaaatagaagggggccatgagccaaagaatgtaagtggtcctagaggctaggaatgaccttcagcttacagccagcaaggaaatgggacctaagtcctttaactgcatagacctgaattctgccacttttgtgcatgatcaagcagattctctcccagagactccagaaagaaacacagccctgccaatatcttaattttggcattgtgagactctaagcagagacaaaattgagcctactgaacttctgagctatggaaactgtgataataagctactaaatgtgtggcaatttgttatggccatgatagaaaagtaatacccccttcatgcatggatctggttcaacatcaggtcacaaactgagaacctatgggatttgtgtttgtcctctttgctttggttgtgattttgctctttattcaaattcattgactatggttaacacaacttcattaaaaaaaatccagatttctgaattctcttgaaaatgtagaagatcttgcaacattaaatatttccatatggttacaaacagctggatccaagtagtgggattcccctttagataagggatgtgctctgtagtttgccacagttgcacttttctctcttgcaaccttacactggatttaattcgcacatacatctcaccccagtatgtgtgtaagtcagtgactcctgaaaaacagttttccaaagtaagaaaatgtctagccttcctagcccttataaaaacagtgaggaaactgcctgccctcatattccaagcaggttaccacattattatcttcaggatagaaggagagcagaaaagggttacccatctctcttcttctgaggcagctctctgatattttctcattttcatcttctggaccctggagtccaaatgcttcattgctcatgtttcatgtccatgcacccagggcctaagcaacaactcttatctgggacactggcctccaaagtcagagacaggaaggtctaccttgagtcacagtgtcccaggagctagcaagaagtagactttgagaaaaatcataaaggaacaacagtgttccccgtgtatcctgcagcccatgaaatgctatattcatctccaattaagccagggcacaaccaaacatacctcttgggcttttcaagatcatctgctaggccccagagccaaactgacccaaggcaaatttacattagcaggatcttcccacacaaatactgcagctttgcacacagtatccagtgggctgaaaaggagtcctgagcactcttttatctagtaaactttatcttcccccttataaatcaacttcattctctgatctgagttcctgtttcagtgtccctgcctaactctcagttcccttaatggcaatgaagctgcactgaaccttggtactcttggctggagttctaactctttgcctggtcctgatcagccacattcccacctcccccatctttgtcctcagtgagctggcttttctgtcccacattcttgtctagtagctgaagttgtgcttaatagagatcacaatgttactgtgactttaaatatgattttccatctggaattttgcatggctgtctgatatggactgggctagacctcttgacatcagtattatctgagggagaaagtccaggtttgccaactactctggacatagggctttcagttatccccatttgtgaagttattatactgatagcagtggccttagacctcaaccacttttattacagtcgtatctcagatatagccaagccttcctcaattcatgacatgctctagaatttatacctactagtatagatataaagaattggaaaagaacccagaaatcaacaaatccaatcctatctcttatcttaaagattaggaagaaagaggtctgaagaggctagatgacttgtctaaggttacacggtgatttagaggtagacatagaacctaggtctcccgattcctttcctgaggggtttcccaccgtgccacattcctttaaaatcccctgaaacataatgaaccaggtcttctaaactctcagggttggcttcagtaatctcttaagtcccatgctttccattgcagccccagatagttccccaggccaacagaagactattcatggggttttcaagcatggtagaaaaggcccattgtctctcaaccccagaacatccctctcttctgccaataagagccttgttcctgattcatgtgaaacatgaaacagccacccttaccacgctggcaatgtctgttgaagaactgcttgcagtagaggaagaagagccccaggaaggccagggtaaacaccactagcaggctgctcaccagtgcaacaagtgtggcctcctgagggggcactgtgggtgtatctgcctccactaagctcaactggaaggcacctgtgagacaaaaaaatgggggaggtcagttagcatgggcagtaaacagtcaccctgaccctggacctggacttcctcaggctgtcacccttctccctagggccttccccaattagggtggctatgctggttttacttctttctagagcaggcaaaattataaagaacaaggcaaaataatttgtatatagtgctggtatgtagaaattagtacaattaatcgaagatgcacatatcctgtgatctttctgtgccacatctaattatataatccagatcaatggaaacaagctaaaaaattcatcagtagagcacaagataaacaaatcatgatataatcctaaaatcttacattattatacagcacttaaaggcctttatggatcaatataaataatctagagggggaaaaaggaagttggagaaacagaacatatagcttgatatcatttctataaaacattatacaatacataacaatagcatatattggttatgaatatgcacacatatcacaaaagaacccaagtattaaaacattagtggagagtatggcagaggtatagtgctcaccagttatccacatactcccatgtatttcccttacacccttgcagtaaggccatcagagtacttctggccaatgaactgtgagttgaaataacatgtgtcacttccagactgaggcagttaagaaccagtatgtctcctccatctcttcccctgtgtcattgacctggaagacatatggtctagaatgcacagtcaaatgatgtaggaaggcctttgcatagtaaaaaaaaaataaacttttattgtataaagtcactgagattttgcagtttgtttgttactttagcatagcctaccaacagaatacatacaatttcaggatagtggttgtatctgaggaggtagggaggtaataggactctgagagaatctagaagagaattccattatatctgtggaatctttattcttttaaaacatctgaagcaaatatgcaaaatgctatgatttattaactttggatagatgctgggtgattgcattttaattttatatttttctgcacttaaaaatatttctacatgtttgaaaactttcatgatttaaaaaatatgtcaataattttaaaataggaagtaagtaaatagatggtagacaaaaaagatagacgattagataaatggatagtggtataggcatagattggaccctagttcttcattcagcctcttacaagtcctcagccctaggggctcctatatacttcatataataataatatctcataggtttacaaatattataatttgtgaagtgcttcctaacatccattttctcattagacctagatacccatcacacaaggtatgaagaaaaatgattatcatgactcacccttttttcagaagtaggaaatgaggttcaatgagattgaatgatttgcatagagttgcaaagataatatgttgtaaaaccagacttctaatctgattcccttgccactctactctacatgaaaaggtatgaggggatatgggtagtctttactaccctatcttgctgccacccaatgggatgaggagaaagggaagaagagaactgggtacacacattgaacctcagaggtgggggtctgcttcgtgcacgggatgcactcttggtcctgcaggcctccaatgcgtgtctttcggtagaacctgtgttcagagcaattaggaatggcagggtgatcaaacaagcaatgcacttggaccagttcttcctgggaaagcagctcctaagaatcttgccaacctgaaagtaagtgcccacccctctttctgagttatctgcctctgtgtctttttctgactcagagacccagacactctacttcttcccccattcatgacaccatgtagccaaaaggagacctaattccacaagagaggggtgcactgctttgataccaagtacatcataacttcttttaagtctacagtgagatttaccttgaactttggtcttcagctgagagtgatgatggaaaagcggtcaagtactcatctgtgactgacaatgtgctaagcactttatagaggtatcttgggaagacaccacttctctcttctgggagcttaaactgaatattatgtttataagaagaatatttcgactaagttctgagaggtgaggatgggagaaacctccaacagctagaaaagcccagacaagcttggtctcataaagcaagctcacctgggcaaacagtccccacagacagcattagaggtagctgtgcagttgaccttctgaacacgattgatgacagcacaggtgatgcaactctgacatctgtggtggccccagctgcttttgtacctgcgaggagggcaggctgtgcagtaggcatctccaccctctccataaccacaatcctgtagacagatgggggttgttaatattgctttataggagcttggagatgggatcacctgtgggacaagtggactgtacagggtagtattttgcaacttgcaaccccattactaagtcataaaaccaattcactagcttccagccagcattgaaagataaaatagaatgaaatagaataatagtatcaaatataagagtacatggaatgaagtaaagctaagtatttgtatcagtcagcataggctatgctgcagtatggcaaaagtcaaaccctaaatctcagtgtcttaaaagaataaaagtttatttctcactcatcatatttgcctaccagggggttcctgaggactctgctgtacatcatcctcaatggggtacccggggttacagaagctttatttttctgcttttatgattgaaacattgtgaactgcgtacaagctcttaaagttttccccaagaaatgacccatattgctttactcacatgtccttggccatacacatcacatgatcattaataactacaacaggtacaagaaaatgcaattctacaatgtgacagaatgtggggagctgaaatatttgacaaatagtcataagcactacccacataagtactgttttataaaagttttacagataaaatgcatgaaagtatatattgggttgtgataaaaagttatttcttactctaggtcatggtaaaaaatgtttgaatgccaatggtatagatgagaggcaaacactctagctggctcttgtctcagctctggtactaactttggccatattccttccccccgacccccagtttctgggcatcagaagtcccaacactgaggaaattgaaataaatgctctctagagattcttagatctgacagcctaacttcaacaggaacaaggctcctgcctgataccagtcacagctctttctcaaagaaacaattctagttgtgaaagcatattaattgtatgctagttgtagcagaagctggctggttgttcacttaacctattctttatttctcctgggaacaccattagccaaaattctttaaccccactgcaatgaagtgggggcatgtgcatcatttctagccaatgaaatatggatactaatattgtttgccattcccaggcttgactcaaaaacatgtcctgtgtgatacttaaattttcttcatacattcattttccagtgcatgctgacacccctggaaaccttggaataaatatattaagaatgatagcggaagccagataaaatggaggagtaggcagcttcaagctcttatgcccctacagaaacatagaaaaacaagcaggaactgtcataatcaatgttgtcagaactctggaaaacattcaaaggcttacatcaaccatgtaaatgttaaatcaagaaaaaggtcacttgaaaataataggaaagttttctgctatttttacttgtacttgttacatccctcaccccagagcagtggcagtcctaaagtagtggaagtcttaaagtagcctcagcctgtattcctagtgtgagacctcagtacctgattccagagtgagctaagcaaaacttattgacaaattactgtgtatgtctgtcctaacctatttgagggctatttgaaggactgatacaaggtatttatgtatgttccactcgattgagaatgcagattggaaaagtgatgggcactgtttcaaaatgttgcaaggcaaactaacaaaccacaatacctagggcaatgattatggattaagacataaaacagactgtctgaatctgggagcaaaagctgggggaggttcctttagaaataagtacattcaaaagtatccacatggaggaatttagaaaggtgtgtgcatacaagacacatgctcagaaaatactagtggagacctaaagcttacatgtcaggctgatccctaagctaagtgcacatctggctaactgtttaagtagttccccagcacagagccaatctaaaaatgtgagagtaatgtgtgactattttttcttttggttgttgttgtcattttttaacttttagcattcaatgaaattgctgtccaaacattagctgaacatgagctaaattaacataggtttcaatggcgatacatgacaaaaaatagtctctacaaaaatagtttggaaaaacacctaaacaaatggagtgctagcctaggcaacacggcaaagccttgttgccaaaaatacaaaaattagttgggaatggtggcatgcacctgtggtcccagctactcaggtggctgagatgggaggatcgctagagcccgggaagtggaggctgaagtcagcaataaccatgacactacactccagttggggtgacagagcaatacccagtcccaaacaaaataataataataacaataatgataataataacaacaacagatggactactatagccttcaacaacacaaatctagaaaacaaacaaacaaaaccaaaaccaaaagtaaaacaggaagaggggaaatctgactaccagagttacttcattacaatacaaaactgcccagtttttaacaacaaaaaaataaatcacacagtgtaaaaagaaacaggcaagtgtggcccattcaaaggaacaagaaaaagaaagaattgagactattcttgaggaagcccagacattgcacttagtagacaaagactaaaagaactgtcttaaatttgctcaaagacacacatggacaaagaactaaaagaaatcaggaaacaaatgtataaacaaagtgagaatattggttaagaaaaattgtaaaatggaaccaaacatgaatactggagctaaaaagtaagataaatgaaatgaaaacttcactagagaatttgagtaggtaaaagaaagaatgagcaaacctgaatgtaggacaatttaaattatcaagtctgaggagaagaaagtaaacagaacataaggaacttgtggaacatcatgcaggtgaccaatatatgcattatgggattcacagaaaaaacagggagatgggggacgagaatgaatatttgaagaaataatggcttaaaacttctcaaatctgatgaaagacataaattaacccatccaagatgctcaagaaactccaagcagagtaaacataaagagacctatgctgagatacactatcaaaaaatgtttatagctgaaaacaaagagaaaatattgaaaatcaagagtgaaattacttgtcaagtaaaggtattctcgataagattcaaagcatatttctcatcacaaagtgcagagacttaaagtcagtgagatgacatataagtgcctaaacaaataaactgttaaccaagaactctatatacagaaaaaagttcttcaaaaataaaggaataattaaaacatccctagacaaacaacagctgattgatatcatttgacctgactacaagaagagagtccttcaggctgaaatgaacagacaatggagagtaacccaaagccatgcaaagagtaaatatctctggtaaaggtgactgcatgaaaaaatatgattccacttacatgaaatatctagaatagcaaaatttgtagagacagagagtagaggctatcaggcactttggggagggggaaattgggagttattgcttaaggcatacagagactgtatttggggtaataaaaagtcttagaaataaaggggtgacggttgcataacattgtgaatgtgattaatgctgctgaattatacacttacaatgtctaatacagcaaatttgagattacatattttaccacaatcttaaaaatcataatgcagtataccaaaaaccatgaattgtaaacctaaatgggtgaattgactggtatgtgaactgtattttaataaggctgcttaaaaaacacagagctcccataagcctggcttcctgaatggctgagaagaatcttcctactccccaacatggattggagtcacattcaggaataaacccttaacctcttatgtcaccaaactttagtatttgttacagcagttaatattacctgaactaacatttaagttatactttcccaggagttggaaaaagtgagcatcaggcaggctcgaaatactccttccattctgccccatgtttgcccactcaggctttactcaatgccttgcagcctcactcacaatgatcccatctaccaatgggatctgacatgggcagtagtcattttactcatgctctaagtttcttgaaaagttaaagggtttcttggaatctctgctaccttatgtgcaccactggaatggtgatagcttccatatctgcttaaaacagtgagctgggggtcaaattattaggaaatataatgtagtgatgaaaatccctgatccaaggtaatgaagacctatctttaactcccacttttactactgaccagcgatgtgaccttgggcaagtcattgggcctgaattttcttgtcaatccaattggaaataatgctatccaacttatagatttgttaagattacatgagctgaccaaatgaacaaaaggaatatcccaaagcaatggagaatagctggctttttaaataggttatgttggataaccgaatgacaatgtgaaaaatgataaaatttgatacattcctcacactatacaccaaaatagatcagaaatttatagataaaaattaaaaccaaaaagtaccaaaacaaaatataaataaattcctctttaatctgggagtggagaaattttctctaactgcaacacgaagtccagaagcagtaaaggaaagatagatataattacataaaaattttaaaaagtttcagggtaaaagattcataagcaaaattagaagacaaataatgaactagtaaaaagatgtacaccatatcacagactaaagatttatattccgataacacagaactagtataaattaacgacaaccaccttatgagaaactaaacatatattcacagaaaaagaaacacaaacagctcttatttagataaaggatgtctcttaaccagatacacaaacacacacacacacacacacacacacacacacacacacacacagatacatatatagctctgtgtgtgggttgtgtgtagtgcttgtcaccatgcctagaacatagtaatccttcaatgaacagatgaacattaggtattgttcttctggaaagcaagtttttattctatctatagcactggaatcagaagatatgtgcctgactcctcacttactcacttgctagagaagggaatgacaaaagcaagctagcatttattgaaagttaaccaataagttgagtgattgattgattgattaattggttagcactccctttcattttattggttaactcagaaaacatttttgaagcaactacaatgcatgaggatgctattctgaatattgtgactaaataattgaatcaatcagacaaaaatccacacactcatgaatttatatacttgtttattcatcataaaaccttataagggtgcaatataatccatgtttcacaaataagcaaaattgaggcacaaattgttggcctgagaagcctcttccccatgggcctgcgattccccacacacaactagagacaataggctgcagggggcacttgagattccaccataagtaaccagctcaaatgcttctttgtcctgtgggtctgagattattttcccccacataggaacaggtggctggggtatactggcaagtggtatcctactaataacaagtggtcgagcatgggaaatgttctttgactctacaactcagacacttctttatgccgacctaaatggaccaagtgacctggcccaggaaatcgtctatacctgaggcagcacaagataaaccccgcagaccaaaaatcacactacaaaggttctggaaattaaatagcctttagaactgcagctcacaaacgtaggccaaaacctgtatgctaaacataaacagatgactgcctgctaaagtaaaagtttaaataggaccctgagtctcctgacataattgacaaaatgtccagaacacaacgaaaaaccacccatgataataagaataaggaaaatcacaacatgaatgagaaaagtcaattaactgacagcaactcttagataaagcagatgttggaatgattgaacaaggattctaaagcacccataataaaaatgttttaaaaaacaatttaaaattctcttaaaaatagaaaatctcatcaaagaaacagaagttttttttaaataaacagatggtaattattaaaaataaaatgacagaaattttaaaaattcactggatgggcttagtagtagagaagagacagatgatagaatcagtgaacttgaggacagaacaacagaatttatgcaatatgaacaacagggagaaaatgacaaaataaaatgaacaaagcctcaagaacctatgagactataacaaaatatagaaaaatcatattgtcagaatcttatgaaaagaaaattttttaaatgtttatctaaaaatattttcaaacaaattggaagaaaacttcacaaatttggtaaaagacctacaagttaaagaggatgaacagatcccaaacagaaaaaaatccaaagtaatgcacaccaatacacatcataataaaacttctgaaaactaaaaaaaatatattgaaaatagccaagaataaatggcattacctatagaaaaacacccattcaaatgatacgacagtgggtttctgtcagaagccatggaagccaagaaggaagtattacatttttcaagtactgaaataaaaaaactgtcaactgcaaatttatatccagtgaaagtatccccagaaatgaagggacataaaaacattctcaggcaaaggaaaactaacagaatgagttgctagtaggcctacccttaaataattctaaagagagttcataaaacacaaatgaaatgatttaagaaagagtggaagtgataaaagaagaaatcttggagcatcaggaaggaaggaacactgggaaagaaaaaatatggttgtataaaatgtactatctttctcttcatacattttataaatcatagtagatgactaaaacaaatttaacaaaaattatatctgatattcgtgacaatgatatttaaaagtggggaaagtaaaggaatctaaatggaacagatatttcaatacttcacttgaaatggcaaaatgttgataccagctgacattgaaaaagtaacgtgttagtttttcatgtaatactcagaaccacctctaaaaaaatgatacaaagagacacactcaaaaacactacaaataaatcatgatggaatcctaaataaaatgttcatggaacccacaggaaggcaagaaaagacaaatagagggacaaaagaaacagagaaaacaaacacaaaaagaataaaatgttaggtttaaatcttaaaatatcaaagattatttaaacataaatgttctaagtaagccaattaaaagacagggattggcatagtgaaataaaaccaaagactatcaaattgtactcaataaaaattaaataaatgaataatttttaataaattaaggagcaaattatcattaaaaatttattgagaattctccttcataattaggaggcaaaggaagttctttcaaatcattaaggtgcaaaatttcttttgctattaaccacttttatagccagaaaacattgatattcttgattttgccatggtagcacaatgctgatccaaaattttgatgctgatagtgttacaataataattatttgttttagttaaaatactaacttatacaacataaaagggtatttaccttaaaactataatcaagaatggtttatactgggaatgcaggatatttaaattttaggaatttattaatacatgtcatcaaattaatacatcaaagggaaaatatatttacaaatcaacagatgatactaaaatgaaacaaaatttaaaagcatttctggtttttaaatacaaatatacttacattttaaacgatttttaaaatactctgttatctactatatgtctgtctacttaggttccttatgtgagtagacaaagaacaatacataatgaatagaaagaatagaaagagaaacaatcagaaatagatcacaaaattggaaaggcaaatgggcaaataaacacagtaaagttggtacatttcccctatcaaatagataaaaagtaaaaccaaaattctcataaagtcctcataaattagtaattactgttaaaaggaaggcataaaattaatagatcatgaaaatatctattattcatttgcgtttaggcttctgggacatgggaatttgttgtgggaagtcagggaccccgaacagagggccacaacaggaattctatgcactgttgaaaataaatgtaatggtaatagaaattagtataaacaaaattcagaagtgttatctgctgatatatttcaagagtcttaaaatcgtacgcattatttagcttggcaattatacatcaagaaaaatgtcctgaggaaatggtgttaattttctgcaatgatttatttacagtgatgtttataattcatgagtaaaatttaaaagtaaataaaagttactttaaaaaaggctatcagatgcttctagctgcttattcaaacaattgcccctcttcttccttactataaaaacactgatttcattctaggtggcatgaagactagcctccagaacggattcttgattggtcttaatcacacaatcccattctcattggccagatacttatttcccagtctctattccagctaaagatagctacatcacccagttctggaccataagatataaggaaaaatctgttggacagcttctgggaaaagacttcttccctacaaaaggcaagctattttgaccttgcccctgattcctgactttgactattgtatggagatatgatgctttgagttttgcaatcatgaggccacaatgagaacaaaacagcaagatgtccaatatgaaggatgaaaagaggctgagtccttgataacattgctgatctgcccaacaagcaaaaaggttgcctgtctccagacttcattacataaataaatatacttatggttcatgtcatggttaaattttatgttactttcaacttactacatcctaattgattctgaggtgaaataatttgcccagagcaaagatgggactcatgcccatgtgtatctggctctaaagcttatatgtattacacatatataagctttaatatctattttaatgtccagcatgaccttacctctggcgatctttccttggtactgggatcctttatcaaccatgtgggtaccccactgtgggacataatgccatgtgtaaaaacttagaattagtgcttgtatctcttgatatccctgcgccttattctcttcattttttaaaatacaaaggtaggaataaagtgggctagataattattatgttgttttccagccacagattcctataactttccaacccaaaaccctccaaagagctcctaatgcacttagagaaagatgaaaatttctcatagacctcaagctgctatctggtctggtctatacttctctctctgacctctttgtgtactaccctccctctcattcaccatacacccattgcactaccttcctccttttccttcaaaatgcctagttcattttcaccttgggactctgcactagtatcctctccccagaggctgtctccttagggagacctttccttgtttcataatctgaagtagccacccagtcaccctaatttgattcttctcatatcttcatatccagattcttcatttatctctgtatgtgtctcaattattattttttcactaataatagaaggtaaggtccatgaaggcaaatatttttgtttgttctgccatatccatggtgtctacaaccatgcctgccactctgcaagtgttcaataagcaactgctgaataaacaaaaattgcataaaatagagtgtgaatatgcagaaaccatctgctagctgcttgcttctggcctctgtagccccagctgcagccaaaatttaataccacccccaagttcagggacctacaagggacctgaggaaagaacaattaagcagatccaggcttgaaacaagtaagttacataaagtctctgccttgctggtcattttattctgatccttatctttaattgggattttagaccctccgtggttccctatccctatattctccattgcacagcttcctcagtagcgcagaccctctagaacagaggtcttcttggctcttctctctttctcattcctaagacctgatatctggctcttgaacaccatgtggttgggccttgctttagatgacagattaccctaatgctgaacagtcctcatgggtctctgcattacacatctattcttgaaatactctgttatctcatggaaacttcccttgaccttgatcctgctaggctgacttcatgctggaatcatgactgctattgcatactctgtggatcccaggttttacccgctgaactggatcagtcataagtagggctgactcccctaatcttggcctctttcagttgccgggctggttcctaagatgcaacagaaataagtgtactgaataggataacttaccttggatagctcctgtccaggaccacaccgttggcaggtgacacaccgtccccattggtcccagtactcattttcttggcaatccatggtgggaaggctgtgggtagagaacacaagaactagcaagctagtgggaagggactataagtagtggcttccatgccacttggcttctgggtccccttaatctattctctagatctgagatagtagggacgaggaagccaacacaaaagagttaatgcttatgtagctctgaccatgtgccatgagttcttgtaaatgctttgcatgtagtaactcattccattctcaagacaatcatattaagaattattgttagcaacattttacagatgaagaaactgaggcaaagagaccaagcaatttgctcaaattcacagtcagtggctataccaggagctgaatttgtaaagagagtaataagacaaggagttggcttctgcccagggggtaaagaataatcacaatccctcatgtgtgaacagatcataacaatttagaaagtactttcacatctattattatttgatctacacaacatccatgtgaggtaagcattatagagattgtcatctttattttataactgaaaaagctgaaacattgtttctctttgccaacagtggcctcagtacctctgaggaccaatacctgccatagcttctgtcttaggcagaatgggaggggagaataacccagaatgtagacatattttggtgcacaaaggtgcacagatagggaaacattactcagataatagttcttggaatacagatgcatatagcagtagagctagcattgaagtgggatggctgttcaccaagcctggctcttaccctttcaatctacaatctgggatggatcactttatcttttctggcctcggttacttaatctaagaaaaagggatagaatgttcttcacctattgtatatagctcttgggagggttaaaggagctaaggtccatcaaaccattctaaagagctatacaaaataagacagagttaagtatgcagaaaggttgtcttctacaaagaggaattttaatgaaggggctaaagtaattcataaatggggcttatcctactcaaagagaaaggtagcatgaggttctttacttactcatgacttcatactagggtgaatttcaagtggtttctaaaagtgccaaagtcctaaatgtgtactcttagtcagaagagacgagagtgtacatgtgtaccttgagaggccaccactcctccactcaaagttccccaaaagcgacaggttaagtcattctaaatggcattccataagtgcacctttttttcatcatcaactgggccattctttcccattccttcattcaaaggaaagtgggctacaagatccatgcttgcataagataaacatactgtcttctgtgctgatttgattgctggcccatggtgttggcctcagtaggcatgcttccctccccttgccatgcactcttctccttgagaacagaaaacttcagtattctcatagccttcatgaccaggaagttaagcaccacagtaacagggccaggaaactgctctggacaactttctcatatccctttttgcccacaaaacagaaaaacattggcaggaaccaagaagtagccctctttttgagctaagttcccaacataggcgtttaaaatctccatgacaactgctgctggcatttgagggtctgagacatcctatttcatttggtttctagagctccacccccctaataaacatcatgtgtcctaaaccccaacatgtctctctaaccatggctttgaaacctctgtctaggcaaggcaggcttggtgccaaattgagcagagggactttctctcccctcttttttccctccctccctcccttccttccttccttctttccttccttcctttcctcctttctttctctctctctctccttccttccttccttgatggagttttgctcttgttgcagtgcaatggtacagtcttggctcactgcaacctctgcctcctgggttcaagtgattttcctgcctcagcctcccgagtagctgggattacaggagcatgccaccatgcccagcaaatttttgtatttttagtatagacagggtttcatcatattggtcaggctggtctcgaactcctgacctcaggtgatccacccgcctcggcctcccaaagtgctgggattaaaggcgtgaggcaccttgcccagccttccctctttttttctcatactatttattcaaagcatacaaattaaattatctttcattcgacgcttaacaaattgactttattaaagagaacaaaattatagattctggactcttttgaagaggtcagggcgtatgtgtaaaactacctaataagggttaaatgtcattacctagggagaaagtcagaccttatatgaatttttccctgtaatcaacagtttcctgtagcatatgtaaccgccttttaaaagaaaaaataagaaagaataattatgttttcagaaaattatagttactctgaggtattccatactgcagctagacactcttccaaagtatcacaaaggatgtggctgaatcctctaaacttctggctaagttggcaatatatacagacctataaagttcccaagagtagagaccactgcatgcccagtgcctagccctgcacctggcacagagtgtgtacctcaacagtgcttactatttgttagcttatcaacatgctacattccctggactatggttaactatgcatatgaatctagcaacatagatcatttctctttaagataatgactttccaaacaatagtagtaacctcacatccatcaaaaaaagagcaaagctcttagttagggacatgtagacttgagttttaattttaattctgcatcctcaaacaaatagttttacctttgtcagcatcagttttttcatctgcaaaatggatgtttaaataatatactgcacagtaatttagaaaattaaatgcaataatacatattaagggaccaagtatagggcttgatacatatgagacgtttggtaattagcaggttccctttcttctttcctcttcagaagagtgaggtttatagtaaaaggagtgcacatttgtcatttttgggatgtgtggggaagaaaaaggaaaggcacccaagcttcttcattgaccatttcagctggagcatgaaggccatgtttaagatggatgccactatagcagtttcctcctcattaatcgcaaccaccagtgacctgatgcttaaggaaaagattctccaagataccctcagtgcctaagccaccttggctaaaagaaacattgttctaagtgtttgctggatttttttcatcaaggcatttctgtataggattaacttggtcaacaaacgtttggaaacttttccgagacaattgcctttgaaatggaagtgaaaaagaaataaaatcagatttgcaaataagtgaggatgttattatggactttatgaaatagcacatgattttccacagaacagtccctctcacctccacaacctaaggttatggctgctcaagaacatttttttcaccccaactctgacatggggttgtgttctctttacattactgagggttggggagaggaagggaagtggcagatgcctcttgtctcaatcccatggagtataacacatgatgaggttctgattctgctaaagcgcatcacccactcagttgtactgtttgtcagctacaccctgaaatacttcctccaacttcccaacttgcccagagaatatctgatctgtgtaactcagaagttacacagatgaggtaatgtggaagtgctctaaaaattcatgtgggtaacatgctgggattttttgtctgtttctgattgcagtacaacatatacatagtaaggagcataaagattaaataaattaataaatttttactgtgtacatgcccatgtaaacaccacccaaataaatacacagaacttttctattaccccagcaggctccctcacgccccttcccagtcaatatcgactcctccccagataattacagcactggcttctatcactacaattagttatacctgtccttgaaattcacataaatttgaatcatacaagatgcgctcttctgtttctggtttctcttgataactataatgtctgtgatagttatccattatgttttgtgtagcaacatttgttaattactattgttgtgtagtatcctattgtatggatataccacaatttatatatttttcttggcaaacattggactgcttttaatttgaggccattataaattgagttgctatactatggtcaatggattttttaaagaatgccaagaaaattcaatgagaaaaaaaatcttttcaaagaagggtgttggggaaactggatatccacatgcaaaagaatcaaatcggacccctacctcatatcatatacaaaattaactcacaatagactaaatccccaaatgtaagagttaaaactataaaactcttataaaagttttcttacaagaaaacataataattctgtaattaatgtttttcttataagaaaatataggtgtaaatttttgtgacactggattaggaagtagttgcttagatataacaacaaaagcacaagcaacaagagagaaaaacagaacaatgacatgtcaacaaaatttaaaaattaaaaatgtttgtgcttcaaaggacaccatcaagaaagtgaaaagacaatccacataataggacacaaaaattttcatatcacatatctgataagagacttgtatctaaatatatagaaaactcttgcaactcaaaaaaagatagataatttaaaaatgagtagagaatttgaatagatatcactctaagacttacaaatggcccataaacacatgaaaagatggtcggtgttatcagcaacaaagggaatgaaaatgaaaaccacaataaaacagcactttatatccactaccaaaaaaaaaaaaaaaaaaaaaaaatagccggccaggcacggtggctcacgcctgtaatcccagcactttgggaggccgaggcaggtggatcacctgaggtcaagagttcaagactagcctggccaatatggtgaaaccctgaatctactaaaaatacaaaaattagccggggatggtggcaggcacctgtaatcccagctacttgggaggctgaggcaggagaattgcttgaacccgggaggcagaggttgcagtgagccgagatcgtgccattgcactccagcctgggggagaaggatgtggagaaactggaacccttgtgtattgctggcgagaatacaaaatgatgcagcccctttggaaattaattttgcagttcctcaaaatgttaaacatcatgttacaacatgacccagcaatttcactcctaagtgtaaatacccaaaagaattgaaaacatgtgttcatacaaaaacctgtaaacaaatgttcctagcagcattatttataatagccaaaaagtggggaaaatccacatgttcatcaactgataaatggtaaacaaaatgtggtttatccatacaatgaaaattattcagtcagagaaaagaatgatgtgcttaacatgtgcaataacatgaatgaacgttgaaaacattatgctaaataaaagaagctagacacaaaaggacaaatgttgtatgattctatttacatgaaatgtccagaataggcaatcaatcataaactagctttagtggatatcagggcctggggagaaagggaaatgggaagtgactgctgaataggtatgtttctttctagggtcatgaaaatgccctggaattagacagtggtgacggtcgtgtgactttgtgaatatgctaaaactagtgaattatacactttaaaaaggtaaatcttatagtatgtgaattatatctcattttaaaagatggttctttagctttatttaatactttgaatttattattccaataggatattgcttaagttagccccccaaaaaatgttaaagctgctatgaatatttttacacaggcctccaaatataatttgattcatccaacttctcacccaaacttatccaagtatgtgttgtatataccttgattgtgtttacaagggccaacaagtggcaatatgactagaattattcccttattttgcctgtctgtcatgtggctgctcttcccacccatctccctgtcctgattcctcaaaaaataatgtagacgattaagaatgcaagcagacagggaagaggagaaacaatacagctgacatcaatagtaatccccaaattagctcatcatgccctgaataattgatgttggccaagtttctgctggatgtgaggtacccaggctgctgggggtgcagctgctccttgctgcagcttgtggctgctgctcttctcaacttgcacacatgcctgtggggtgaaacatgctctctctatgtagtatgggtaggcaggaaagaaggacaagtctaaattaagaactcagtacttcaggatatttgctttgcctggacagtgcaggaggtgtgggattaaaaacgatgaagaagacagcagatggtctccatgccttgcccattcctctactgcgagcccatctatccacccacatgcacaagacagaatcaaagaagttgctcaacgtagccttgagaacactgctttcttgaaaatcaagcttctaaactgtacagtgccatcatttccagatgcctggcctgtaattcaaatgttgctttaccttttggtgttggcactcagcctttcccttttctgaactgacccaaggccacttctatccaaggtttatcttgtttataacctccttccaaactatcaaacatcatatcttccttctgccccactatttgtaaagtttgcatttcctgttttagctcagcatagtgaatggtcctagtcccagctctgccatcaggagaatatcccttcccaatgctggaatcaagttctccattcataccacgagggagttggtttggctaatctcttagaccagtggttctcagtcttggttgcaccttgggagtgccaaaaaatagtgacacctgggtccctcccctaagattctgttgtagttagtcaaaaatgtggcatgagcacgctacattttacagttcaccaagtgattctcatgtgcagtcaatgttgaaaatcacagttttaagggctcttttcttttagttctgaccttgtctgtttcacctgaaaataaaatgcagtcagaaaaaaaggtttttctgtatctctcccccatattcagagagaatctgttgagggagaaacccaaggtctatccatttttttctagggagaatagaaaataaagataaaggggataaaacatgttagatcatgtcatttccagcctcaaaagccattgatggctccctctttcactcataatatcacataagtcctacacagttttggatataacttaaaaaatgaatgggtatgtaaaaacataaaatatacacagtgatgtatggcatataataaagagctcatattttaaaaaattaagttcttataatggccaatagagaccttagatgatacgcctacctcaatttcccccattatttattgaccttaagttctactactcttttccttattgtcttcactccacccatgctggcctccttgttgaacttcaaactaaccagaaatgccttcatcttaaggccttcacatctgctgttccctcaagcaggaatgttcttccccagatacctgcatggctacttccctcatcttcttcagttctttgttcatatacagtcttcttagtcaggcttccctgaccactctctcaaattttcaccttctttccagaattcctatccccgtttccagttttattcttttccatagcacatatgaccttatgacatatcataaatcttatgtactttattgctttttcttccccagttagaatgtaaatgctatgaggccatggtacgtattgtgtttgctacttcatcatcagtgcttacaatagtgcctggcacacagtaggcattaaacaaatatttgttgaatgataaaatggtgaaaatctacagaatactgggaatactctcctgtctgagtaaaaggtttcatagtttataaaggattttacatcgattagctcaacagatcaccatcacatccctaggaggaagctagggattgttatcaaaaattaataaatttgggcaggtgcagtggctcccgcctggaataccggccctttcagaggcctagatgggtagatcacatgaggtcaggagttcaagaccagcctagccaacaagatgaaacctcaattctactaaaaatacaaaattgagctaggtgtggttgcatgcacctgtaattccatctacttgggagactgaggtacaagaattgcttgaacccaggaggctgagtttgctgtaaaccaagattgtgccactgcactccagcctgggcaacagagcaagactctgtctcaaataaataaatgaataaatacattaaagaagaagatcacatgatgaggaaggaacagacagatctgagatcttgctcaagatctcagtaaagaagtagagctgggggatcatcatggcagacgggaggcaggactagattgcaattccaactcagatggacagagcagtgtgaggaggtttgcatcgtgcattttagctccaggacgactgcaagaacaaaccagggatctcgagaggacctacagacactcttaggaagtggactgctcctgcaggacccaggagacactccaaatactttgagcactccaacagcagaagtgggaaagggagatcctccattccttaacacacacccacactggggaaacacttaacacactggggaaacacactggggaaagtctaatttgcaggagaagtttctgactttacctggagctgagtcaatttagagagctgagcaaaatacaggggtagaggaagcagcgggaaaagccccgggagtttgctgggtccccaagcaggcctggaaccacagggaaccttcagaagggtcgccagaggcacaggggaaaatgccacggggaaaaggaagtctccagctgaactttgtaacaatttgaaccagaagagaagcatcctggccagaacttggggtagggcatgaatctggtgtggagactctaaaggagtgggaagaaccaaagcccttttatttcacagctgggaggtgggtaacctggggcaggttctcaagccctactcacccattgcctggaaacagacttgggactgttatgggagcacagtgggagtgagactggccctttggattgcatgggagctgggtgaggcctgtgactgccagctttgacccacttccctgaccacctgcatgactcagcagaagcagccataatcctcctaggtacacaactccatggatctgggaacctcacccccacccacacagcagccacagcaagacctatccaaggagagtctgagctcagacatgcttagctctacccccacctgatgggccttccctacccaccatggtagctgaagacaaagggcatatactcttgggagttctagggccccgtgtactactggttcctctccatactaccaaagctgatgctctctgaaaagcaccacctcctggcaggaggccaaccaccacaaaaatagaacattaaaccaccaaagctaagaactgtcacagagaacatttcatcccttgacacctccaccggaacaggtgctggtatctacagctgatagaccaatagatggttcacatcacaggactctgtgcagacaacccccagtaccagcccaaagccggatagacttggtgggtggctagactcagaagagatataaaaatcactgctgcttggctcacaggaagccacatccataggtaaagggggagagtactacatcaagggaacaccccatgggacaaaagaatctgaacaacagccttcagccctagaccttcccactgacagagcctacgcaaatgagaaagaaccaaaaaaacaactctggtaatatgaaaaaacaaggctctttaacaccccccaaaaatcacactagctcaccagcaatggatccaaaccaagataaaatctctgatttacctgaaaaagaattcaggagattagttattaagcgaatcagggaggcaacagagaaaggtgaagcccaatgcaaggaaatctaaaaaatgatacaagaagtgaagggagaaatattcaaggaaatagataccataaagaaaaaacaataaaaacttcaggaaacaatggacaaacttttagaaatgcaaaatgctctggaaagttcagcaatagaattgaacaaatagaagaaagaaattcacgactcaaagacaaggtcttcaaattaacccaatccaacaaagacaaagaaaaaacagaataagaaaatatgaacaaagactccaagaagtctgggattatattaaacaatgaaacctaagaataatcagtgtttctgaggaagaagagaaatctaaaattttggaaaacatatttgtggcaataacagaaaaacttccctggccttggtagagatctagacatccaaatacaagaagcacaaagaacacctgggaaattcatctcaaaaaaaatcattgcctaggcacattgtcttcaggttatctaaagttaacacaaaggaaagaatcttaagatctgtgagactggaaaggaaaggaagaggagggaaggggaggggaggggaggggagaggaggacaggggacaggaggagaggagaggggaggggaggggagggaaagtgtaaaagcaccaggtaacccaccaaggaaaacccatcagattaacagcaaatttctcagcagaaaccctacaagctggtagaaatttgggccctatattcagcctcctaaaaatatacaactatcagccaggaattttgtatccactgaaagtaagcatcatatatgaaggaaagatacagtcttcttcagacaaacaaatgctgagagaattcaccactaccaaaccaccactacaagaactgctaaaaggagctctaaatcttgaaacaaattctggaaacacataaaaatagaacctctttaaagcataaatcacacaggacctatcaaacaaaaacaaaatttaaaaataacaaaaaagcaagatacacaggcaacaaatagcacaatgaatgcaatggtacctcacatctcaatactaacattgaatgtaaatggcctaaatgctccacttaagaaatacagaactgcagaaaggataaaaactcaccaacaaattatctgctgccttcaggacaatcacccaacacataaggactcacataaccttaaagaaaagggatggaaaaaggcatttcatgcaaatggacaccaaaagtgagcagaggtaactattcttatatcagacaaaacaaactttaaagcaacaacacttaaaagagacaaagagggacattatatcatcatacaagtccttgtccaacaggaaaatatcacaatcctaaacatatatgcaaataataccagagctcccaaatttataaaacaattactaacagacctaagaagtgagacagacagcaacacaataatagtggcgaacttcaatattctactgacagcagagatagacagcaacacaataatagtggtggagttcaatactctactgacagcactagacaggtcatcaagagacaaagtcaacaaagaaacaatagatctaacctataccgtggaataaatggaattaacagatatatacagaacatttcaaccaacaaccgcagaatacacatcctattcaacagtgcatggaactttctccaagataggccgtatgatagggctcaaaatgagcctccataaatttaagaaaactgaaattatatcaagcactctgtcagaccaaaatggaataaaactggaaatcaactcaaaaaggaaccttcaaaaccatgcagatacatggaaattatataacctgctcctgaatgatcactgggtcaaatacaaaatcaagatggaaattaaaaaaattcttagaactgaatgacaataacaacacaacctatcaaaaggacacagcaaaggtggtgctaagaggaaagttcatagccttaaacacctatatggaaatgactaaaagagcacaaactgacattctaaggttgtgcctcaaggaactagagaaacaagaacaaaccaaacccaaacccagcagaagaaaggaaataaccaagatcagagcagaactaaatgaaattgaaacaacaacaaaaaaaaacacacgaaagataaataaaacaaaaagctggttctttgaaaagacaaataaaattgatagaccattagcaagattaaccaagaaaagaagtcagaaaatccaaataacctcattaagaaacaaaatgggagacattaggactgacaccactgaaatacaaaaggtcatttcaggctactatgaacatcattacacacataaagtagaaaacctagaagagatggataaattcctggaaaaatacacccccccagcttaaatcaggaagaattatatatcctgaacagaccaataacaggcagagatactgaaatggtaattaaaacattaccaaaaaaaaaaaaaaatccaggatcagatggattcacaactgatttctagaagacattcaaagaacaattggtaccaatccttttggcactattccacaagatagagaaagagggaagccaccctaattcattctatgaagccagcatcaccctaatacctaaaccaggaaaggacataaccaaaacagaaaactacagactaatatccctgatgaacatagatactaaaatcctaacacaatactagctaactgaattcaacaacatatcaaaaagataatccaccatgatcaagtgggtttcataccagggacgcagggatggtttaacatacacaaggcaataaatgtgatataccccataaacagaatttaaaacaaaaatcacatgatcatctcattagatgaagaaaaagcattcaacaaagtctagcatccctttatgattaaaactctcaacaaaaccagcatacaacagacatacctcaatgtaatgaaagccatctatgacaaacccatagccaacataatactgaatggggaaaagttaaaagcattccctctgaggactggaataagacaagcatgcccactctcaccactcctcttcaacatagtactggaagtcctcgccagagcaaccaggcaagagaaagaaataaagggcatccaaactggtaaagaggaagtcaaactgtcactatttgctgaccatatgatcatttaccttggaaaccctaaagactccctcagaaagctcctagaactgataaaataactcaacgaagtttccagatacaagactaaagtacagaattcagtagctctcctatacaccaacagtgacaaagtggagaatcaaatcaacaactcaaccccttttacaacagttgcaaaaaataattaaatacttaggaatatatctaaccatggacgcaaaaaacctctacaaggaaaactacacaacagtgctgaaagaaatcatagacgatacaaacaaatggaaacatcccatgctcatggatgggtagaaacaatattgtgaaaatgaccatactgccaaaagcaatctagaaattcaacacaattcacatcaaaataccaccatcattcttcacagaattacaaaaaaaaaatctaaaattcatgtggaaccaaaaaagagcccacataaccaaaacaagactatgcaaaaagaacaaatctggaggcatcacactacctgatttcaaactatactataaggccatagtcaccaaaacagcatggtactggtatataaataggcacatagaccaatggaacgaaatcaaaaacccagaaataaccccaaatacttgcagccaactgatctttgacaaagcaaacaaaaacataaagtgggaaaaggacaccattttcaacaaatggtgctgggataattagcaagccacatgtaggagaacgaaactggaatgtcatctctcacattacacacaaatcaattcaagatagattaaggacttaaatctaagacccgaatctataaaagttctagaagataacattgaaaaaacccttcgagacattggcttaggcaatgatttcatgaccaagaacccaaaagcaaatgcaataaaaacaaagataaatagccgggacctaattaaactaaagagcttttgcatggcaaaagaatcagtcagcagagtaaacagacaaaccacagggtgggagaaaatctgcacaatatatacatctgacaaaggactaatatccagaatccacaatgaactcaaaaaaatcaggtagaaaaatcaaacaatcccaccaaaacgtgggctaaggacataaatagacaattttcaaaaaagatatacaaatggccaacaaacatatgaaaaaatgctcaacatctctaatgattggggaaatgcaaatcaaaaccacaatttaatacctcctcactcttgcaaaaatggccataatccaaaaataaataaaaacagtagatgttggtgtggatgtcgtgaacaggcaacacttctacactgctggtggaaatgtaaactagtacagctgctatggaaaacagtgtggatattccttaaagaactaaaaagaatcatatatatatatacacacacacacacacacacacacacacaaacacacgtatatatatatacacacacgtatgtgtatgcatatatacatatatacacacacatgtacatgtgtgtatatacgtacatatatacacgtatgtgtgtatacatacatatatacacgtatgtgtgtatgtacataaaaacacacgtttgtgtgtatatatacatatacacacacatgtgtgtatatgtatatatacacatatatattgatgagattcgagactattattcttagtgaagtaactcatgaatggaaaaccaaacactgtatgttcccactgatatgtgggagctaagctatgaggatgcaaaggcataagaatgacacaatggactttggggacttggagggaaggcagtgaaggggggcgagggataaaatactacaaatagtgtgcagtgtatactgctcaggtgatggatgcaccaaaatctcacaaaacaccactaaataacatatccatgcaaccaaataccacctgtatcccaataacctatggaattttttttaattaatagattaaaaaatactgaggctcagagggaaaatatacaactatctttatttggctagcaaaaagcaaggcagaacccaaaggtcatttagaagctatgagtctggcacacttttcaaggcagtattgaactctaaaatagagaatggaggtcctcccagtcttcactgaaattttttcttcagtgatatttcaggatgggcaaaaaagcattttattaatgttaacctgagtgcattttaaataatggtttgatagggttactgcccaagctttaggagacaagggccaggtcaaaggtggttacaataggaacagagaggaatgatggtgggagatacaaaccttacaaagtgaagacaaacagaatgaccagagttagagattctgggagtttctgcctgggaaaccagaagaatctaagtgccatgagaagcgtgaaaggagcgcagcttggtaaaagaaaagaaaatgcactgtttttcaattattttcagtatagagaagttgaaggggacagaggaacatttcagtggtcatgcccaacaagcatatacaatatgtaaaatataagttgaagttggagatgtgtcaaatgcataaaaacaccagaataacagttcttgcttatggctgcacatcagaatcatatggagcactgaaaaaaaaatcctacgctctagattaattaaataaaaacctctggggttggaataaccactggccgaagtaaatcatggcagaagttaaatcatgggtaaagaagaatggctggatgcagtggctcctgccggtaatcccagcactttgggaggtcgaggcaggtggatcacttgaggtcaggacttcaagaccagtctggccaacatggcgaaaaactgtatctactaaaagtacaaaaattagccaggcgtggtggtgcatgcctgtagtcccagctactcgggaggctgaggcaggagaatcgcttgaaccctggaggcagaggttgcagtgagccgagattgtgccactgtactgcagcctgggtgacagattctcaaacaaagaagaagaagaagaagcaggaggaggaggaggaggagggtgaggaggaggagaagggaagaaggaagaaagaaggaagaaggaaggaagaagaaagaggaagaagaaccaaacattgagggtcactcatacttgaagctggaagaggaggaatacatgacagcaacgaagaaggggaagccagagaagaaaaaaaaaaaaaagaaccttgatagagtagaataggacaaagctttaagaagtaagggatgagtaatgtgtcagctattgatactgggacgtggaggaggccaggactgaggatgtgtcatttttattttatttcatgggcatgtgataaaagtaaattatctttttgtgtttaagtatactaaaatctgtgcctggaatagacataatgtagagaccacaggtgggtactacagtttttaatgggctactttcaacatttccaaagtggctgaagaattttaactgttagtgatagcaacatctggcccagcaatgtcaggaatagtatatcaacagaggagaatgaacctgcgcaaaattaaagaagtctcatctattctcctttgtcttttattctagcgcacagagcaagaggtaaagccccagctggggaagaaaaagaaaaaaaaatccttactaaaagctgttgtcattgtacagacaaaattaataaccaactgaactgggctacttccacttggccaaaagtaaatgctaaccatatgagtcaattgttttgccttcaaaacatgcgtacgtgcacaaagacaacaaacaaagcacaaacctcaaaagacaaatacaacttagcagactgtaaattaaaaatataaatatttggttagtgtttggcaactgctgaaaaataattgttaaacgaatggggaaaagagactgtgtagccaagaatacaaagataccattataaaagaaataggatgaaattaagaacagcaaactctaggctgattttgagggaaaacgttcttctactgactgctaaaatactcttcccaagtgggagcaaaagcacagaaactaccctggattatgttcaagggtaaaatgagataatgtatgtgagagtgctgtggaaactccagattgtgctacgtatgtgaggagttgctatgattgttgttactatcccacccagagctggggaacaaagggtattggagacaagccccaagccagaccggcactcagctaacacctgaaacctcttgctttgctctgctgttatcctagccaaagtgagtcactggtcatgtaccaatcaccacaagattccataaaattacggtataataaaaaaattagttactcaaccagcagtactggaaggggagataagctgacttcccaagaaggcttttggctgagttgtcccagttgggtattgaattcatggtatgatttatttgcaggattgggactggataaaactcagtcaagtactccaatttctgatttctattaagtttgttggtcttgccccacactccctccaccctgtcccatttaccaagcaatctggaatagctgtatctgaagatgtcaacaagaacagtctctttttttttcccatggcaatcaagtactccatcccatcctcataggcctgggaataaaatatcctaaaggagcagagatacaaaccagtgggcatttacaagcccaacccaggtccacatccttaacaaaggactggaagaatacaatgagaactatagaatgaggcatgtctgtacaaaatgaaatgctgctgccaaaatatttcttcattttttctttagatgtccaagaaaagggagaaaggtatagtactttgtgaggttgtggagggaaggtgagactgataacaagaagcctatgacctcatatgtaaatgcacattctttgagaccatttttagactctgacaatcttagagtcaaagggaggtttaaaattaatcttagtcccagtggccttttgcccagtaaagaaataccatccagctctacttgaagtcctttagtaacaggcacctcagtactcataagacagcacattccatcatttgttttttttttcctcctctttggcaaccagttaaaacttcaagctatcagataattgaaaacatatagtcatgggatcctaaaagtattattcaggacaacttaaccccattccctgatgatctaagatgaggaaactaatgctcagaaaagggatagaattttcccaaagtcacacagtggtcaatggtagagctaaaagtagaattcaagtctgcatattcagggcccagtggcttctctacttcccatatacgaagaaaggagttggcccagctttaggaccaattactcagtgactatactaccaaggctccagcttctttttcctaactcccacagcccaataatggctcattttatcctcaacagaaacaattccaaagggtgggctgggtcatggagaggtggatcgtagaagggaagaagtaatgcccactctttttggcttaaccacaacggtgactaacaatctcctggaagtaggacatctcagtgtctgattccaccatatattacatggaaaatcctttatttttgagaatagcatgatgtcttttggtggtgtttggaagatataataactgttgtcatcccaagatagggagaattaatttctggtcactcagcaaccacttgatgagtactttctatgctaggcattctattagaacttagtggcaagagaaaaaaacagaggtgaataaaccatattctccaaatttaggagattgcagtctggtggggaacatagaaaatatatacagtaaactctaatccaagacaaagtatagccatcctcatatctatgttcacaaaataatagtagtcgtattttacatactgatggtgaaacttacccatatctttcctgttaagctcccaagaagagaatacacgggtggagctagtttctagaaagaaagcagtgaaaagcagcttctgcttcaatatgaagcttcagcactgaggaatggctccaaaagatgactcactctctgcaggaagcattcaagtggagaaggtcaagaagacatctaaagaaaggaattctctcaaagagggaataactggtataaggtaattggaggatccctcttttttttgactcattctttagtgccagagttggcgtaattgcccagctatctatcaccttaaaccctaacagctgtggaaaatgaaaagccatactgaacttggagtaagaaaaatgtgtcttgcagttctggcacagatgcttactaactaaatgatctctagcaagtttcattttctctaggcctgtttggccacctgtataatatatataaataaatctgcaattccctcatttggggataaggaatcagtgggatgatggatttgaaagtatttagcacatagtggaaaaaatgatttatattctttaatttttttttgagatagggtctcactttgttgcccaggctggagtgtagtggcatgatcatagctcactgcagcctcaaactcctgggctcaggagattctcctgcctcagcctcccaagtagcgggcactacaagtgcccagcacccagtgcccagctatttaaaaaaatttatatagacagggtctctccatgtttcccaggctaatcttgaactcctgggctcaagccctcctctcgcctatgcctcctaaagtgctgggattacaggaatgagccacccttcctgaccagaaaaaaataatttaaaaaataataaattacaaggaattttgtcacatttacccatcctgttccttttgcagtattcctcatcactatgaagacatactcataccccaatttatatacttcaaaaccacagagtcatatttgacttgataccatgccagataagaaatgatacaattatctgagctgtttgacctgggagcagaagatgcagggggatctgatctctggtcttcagatctctgaaaaactgtcatggaagaaaaagaacagactgctctaggtggcctcagggagaatgactaggatatccaggtacaagctttaggaaaactaagttcagcttagcaaaaggaagaacttttaacagtccaaggctttccctgaagacagtgggctctctcaggaagcagtaaggaacctccctctagaagtgttcaagcagaaactggcaaggatgttttaatgtggaatccattagggtaaaggaaaattacaattcatgaaattctacttgtcaggcactgtgctagacccttggcaggaaatatatcttttaatcctcccaataacaccatgatgtgagtactgttatccctctttttcaggttagaaagctgaggctcaaagaatttgactacttctcattgggcttactactggcatggtgggtgggaggaacaattatttgttgcatctgtttggcattaaatgcagtagtacctcagactgtgtgtaaaacacacacacacacacacacacacacaccccacatacttctaaatgtcttgtggaaataccgatcctagttgggaatgtcaagtacataatatgcttaggatcacaaacagcagataaatagcagacccaggacttgaaaatagctgtgtctagctcagaaggtacatactctttctattgcgttatccacagaagtgagatgggaatgcacaaccttgtaaggtctaagccaacccgaaaagattctgattttctcattcttcctttttcaattccatataatgtatcaactacaaagttctgtagattcaacttttgtgatggcttgttaaattcatcacctcctttctattcccacagccacgacctcagttccagggccttgttccctctctgcccctagtttatccccctcttgtgttttcctattccaatccagctgactaaccttttaccagattactcttcctaaagcagaggatctgacgttttttttaagctcaaaaactttcaatggctttccattgtctgctaaatcaaatcaaaactctagcatccactgtcttttgcagtttaccaccaatctgccttggcaagtttaacttccaattttccgctaatcgtactctaaaatccagctcagctggtgttcttttcatatgccctgagcttccctgccttaaagcagttgttcctattttctctgcttaaactgtcttctctatctccacctgttgaaatcttatctgtgtgccacagtctatcttaaataataatagttaatatttattgagtgtttattttgggccagccactgtgctaagtgtgtgcaagtattttatatggattatctcatctaatcctcacaacagccccatgaggtgggtgctattattatccactttagcctgaagttaacagaaactcagaaagggagaagtaattttatttgtccatggtaacacaagttaaatggtgagcatg[450 bp omitted]ctctggcgggtcccttcttgtcccccagttcttgcagcttgctgggtcttggccagtgtttggagtgaggcaggatcaaaataacactgcccggggctcagcttccaggaatgagagatcaagtgaaaccaagctcggcgggtgagggggtggattgaaagcccccaaacagagccagcatgctctttacacaagccctgacttgccctcaagccacgcgggttagcagttctgctttcctcaggatgctccacaagtctgatccactgtccccgccttcactaacacccagcctccttctcttctttatctcccaaccctagatgctcaaggttgttggacacgtccaggcatgttctcagaggcaatgcaggtccagtaagagcctacaggaaatggctcgccaagatcctagagatgtcagcccagatccctgatacctcagaaagcgctctccggacacaaatggatggactgacagccagccacagggcgccttcccaattgttctgattttgcggtaccctagcaggatcatcctgacctgattctgtacttctgcacctagatgccgcaggtcccagccgccttgccacaccagggggtgttcccacactcacccggtaacggacgagtagatggctcttgctcccaaatgggactccggtacaaatccacctcagcgcagagcacacatctcacccagccccctcccgtcaccccccgcccttcaccccgcgcccctcagcccccgcccctcagacccgcccatcagccccgcccctcagcccccgcccctcagcccccagcctgcatacacactcacagtatatgaaattccttgtaatcaaagttccgcttgactcatttcacatccacgtgtagcaacaacagcccaaaccctcctttcacggtaagcttacctcttccgcccccgtgaagttcctagagcagctattggactgtttgagtgcctaggcgtggctacgaaaagaaactgcctttgagaggaacaatgtgaggctgaagaacagtgacccagccactggtatggcaggagctgcaaatctcctgggactgaagcgggggccagagagtagagggccagggagtggggtccagagaaagcatcaagttgtctctttcacagctgaatgcagctcagctcatcaaagtttattcatgacttagcaggcttggagtttgacagggaaaattattgttggaaaagccaaaattttcagacacatggagaagccgctttccagctctgcatctgcctcaaaaaaatactcctccattcagaagggtagataggattgtgacaggaggaagagagcagacatgaagcagggaaaagaccactaaaaataaaggaaaattggattcggcactcagctttgatcatccatcttctctgggcccctgagtgtctgtacaaggagggggttgagctacgtagtctctaagggcacttcaaacaatgacactttgggagtttattaatccatgatctcagaggcagcggtggataaatcccgaaacgttactagtccctgaccttgaagagtttgcagagctgggaagataaagtagaccggacagagacagagaattaagggccaaactatgaggtgcagactggaagggtttgggggccagtaggaagaaggagtaaaaaagagtctgacaaggaaagcaaatgcttttcaatagattaggagcttttaaaagaggtcaaagaggaaatagcctaatgggtagaggaaaagaaaagcttgagccaaggtatgggggagaggaccaagaaatgagccattatcagtctctgagggacccctcctgtactgggcagaggctatatgccagctcagggtggagtctcagtaaagcagctgaaaagcctttggtgggaaagggctgaataggccctaagctgaagtagaaaaagtcctaaatgaacttcatatctgtcccctagctagagttaagaccagaataggctactgtgggctcaggcctagtagaagggaaaactgccagaattggaatcctaggtctgccccttactagctttgtgacctaaggcaagttacttaaccactctgtggctcaggattctcttctgtaaagtggggaaaataacaatcccttactcataggattgttttaggtattatatgagttaatatacaaaatagtgttcatatgcgtaaggagcttagaatgatttctgggacgtagtggtatagaagtgtttattaaatataaataaatacatgaatgcaatttagggacctctgaaatcatctgtgagattcaaatgaaaatagctaccctgggtacctcctaattctgttctgtcctttcctagaaaacaggacctcttctttttctccatcctttcctacccagagaagctgaattacagacagttttgaaactttagtgtaaagaaccctagcttggaatttagatgtcttgacaaaactaagtgtaacatcatgtaaatctcttcctctctcttagttttcctttctgcatctgtatcctgaagagactgttggactggatgaccttgaaacgctagagccgtgcttctctcatattaatgtgcacacaaatcacctaaggatcttgttaaaacacagattctgagttagcagctgtggtgtgggactaagactctgattttctaactgcttccaggtgatattgatggtgctgggccacagaccatagttttagtagcaaaggtttagaaggtggacaagaataacatttactgagcacctataaatcatgcatatgtgtccctttataccttacaaccattctatgaggttgaggttaccatcctcattttgtagatgaagaggctccttgtactctgtgattctgcctggaagtacaggaggaaacttgagatagaggtaccagggatatgtcagagtccacaagctattgtggaaagtgattataagcagcaaatatgaaaccactgtcctccaccataacttgtccaataatactataacagttagctggccctcactaagcacttgccaggcactgctcaaatttttttcatgaattaattcattttatcttcataatctatgaagccacaatcattagaattatcctcccctctccttttgctcacacctcacattcaacccatcagcacatcctatcagctctgcctcctgcctcagagataaactctgaatttcaccaacttcttagcaccttcactgcaaccactctggtgcaagccacgattacttttcacctgaattattgccatatcctccaatagctctccttgctctcatgcttaccccactccagtcaattctcagcagagcaaccagaatgatccttttaaaagtacatcagtctaagtctgtccaagcaattctactggttggcttcttattcagcagaaaacccaaaatccttaactatggtctataatagtctacaatctatcccacgccatcccatcctcactaacctgcccctctatctctgatctcacctcttaccactcgccttgaccaccatacccaaccccaactggcggccttgatattttttccaacactcaaagcatgctcaagactctggtctttgcacttgctgctccttcagcctagccaattcttcccccagatatcagcatggctccttttctcacttcctccatatccctgcttaaatgtcactttatcaaagtggactttcttgaataccctagctagtacaagctaatgggattgcctaggccttttgaaatccactgggtaggtgagctttttctcaacatagccccaggacccccggtgcagtgtggtggtgagtagggttaaggctctcaactctgctctctgtgggggagccactctagctccatgtgcttgtgcagcagaactaagtttggatcagctaatttcttgggggctttccacagcccctccttttatgataaacaggagtcactttgtgaacccaaactgagaactatcagtacagagtttctctacctacattctactgctggaaccagcctaacctgacagcaggataggcaggaccagcctccactctgcttatctctgggaccagacagattctggggctcagtgagattcagggctctctgatgccacccctcagctctctctcagaggttacttagggtcactcaggggaatactggccttggctgtgtctcagagaatcctgggtagcctctaattctagtgtccaacaatggcaggaccacctttcatgaaggagcttcatggttatccaggcagaatggggcccttatagctcctctcaagactgggaccagggggcaggaaaagaagctgaaagactaaggggatgctgaggcctgtggggcaacccctgtaaactcaaacattgctaaggatgtccctgaacacaatatcagcttcttgttctctttagcctgtgagatgtgtgtagataaacttggccataaatgtttgctgcagtggtgtatacaggcttaggtcttctgaattagaaagctggggtataagagttacttctagccatgggaattttcaaacttcagctagattctagcacagtccaatagtgttatctctcattttaaataatcttctattccacttgcccaagatggcttttaaaactcactcttcttaagtcaagtgctcaacacagctcccaaacccctagcagatgacttcacctccagtttcaccgagaatgtaaaagggcacgaaacttgaagtctaaacaacttctgacatctccacattcaagttcatcctgtttcttacctcagagtttcctcctgtccctcctgtctccatctgtgtttactcctgtctattccattttgctttatttgtatcttcatggtctttcttcctctggctctttctcctaaattgtctttccattctgaactaagattaattcttttcatatcctcacctccacctcttcatttccaaactcactacattttgctcttctcaaggtcacccatgattttcatactatcaaacccatggattcttctgttttcttatttgaattatctaaaacatccaacattgtctggattcttttctttctgactctcttcccttgactttcatggaactaatgtcttctagtttcacttatttctctacagcattttatggattctcattctccacttgcccctcaagtgcagggattttacagagttcctcccaccctccattgtccctctggcctgattctaacttctctcactggagtgtgaacctatgtggcagggaccttatataccatttcacaaatttccacatgcaaaactgtacctagagtattttaagcgctcaatacatttttacatattatatatatcaatatatctgttgaataagcccaaggagaaaaatgttcacatttgaatgtatccttctataatgagctcccaggcctcaggtgtgccacaataaaaataagatggctaaaaaggaattgaaacccacacccaaaataataataatagccaacacttgatcaatgcttgatgaactctatatgtcaggccctatgccaaatgttctgtatgcaatagctcatttaatcatcacaataatcctatgaggcaaaaaccatgacatcactcctattttatagatgacaaaattgaggcacagaaacgataggtgacttatctatgccatctatcagtgccacaaccaataagtggcaattgacccaggattctcaagaatagctgatgccttaattattcactgtcacactcaaatgtacaatccttgctttcccttccaatcagaggctccttccatcctctctgaagagctattctaaacctctacctttagaagtaaaggttaagttcctactttagcactgaattcttagcccagaaacattgactcttttcttcttcatcaataaaacagattctattaggcatttagtgcctataacttcttccctaattcctataaggttctctctgtcttcattcatcttggcctttcctcttgaagaagaggagagaatgcctcccctgatatttatgaatctttctccatcaattacccccactctctatggcatcattatttacctgtcttctgtgcctacccctttaactcgtaaacatatttgaattcctcccactacaaaataaaatcaacccttctaccacatttcctctttctcaaacaacagcctcgtctcattttttttcttagccaaatttctggatagagttttctctaataactgtttccatgactttaatttccattagctccccaacctactataatctggcttctagccccatttgttctccctaaagctacaggggaccacttaactgccaaattttaggaaacattttctctcatctttttttttcttttttttattatactttaagtttcagggtacatgtgcacaacatgcaggtttgttacatatgtatacatgtgccatgttggtgtgctgcacccattaactcatcatttacattaggtgtatctcctaatgctatccctccctccttcccccaccccacaacaggccccgggtgtgatgttccccttcccgtgtccaagtgttctcattgttcaattcccacctatgagtgagaacacgtggtgtttggttttttgtccttgcgatagtttgctaagaatgatggtttccagcttcatccatgtccctacaaaggacatgaactcatcattttttatggctgcatagtattccatggtgtatatgtgccacattttcttaatccagtctatcattgttggacatttgggttggttccaagcctttgctactgtgaatagtgctgcaataaacatacgtgtgcatgtgtctttatagcagcatgatttatgcacctttgggtatacatgcagtaatgggatggctgggtcaaatggtatttctggtactagatcccggaggaatagccacactgactttcacaatggttgaactactttacagtcccaccaacagtgtaaaagtgtccccatttctccacatcctctccagcacctgttgtttcctaactttttagtgatcgcccttctaactggtgtgagatggtatctcattgtggttttgatttgcatttctctgatggccagtgatgatgagcattttttcatgcctctgttggctgcataaatgtcttcttttcagaaatgtctattcatatccttcgcccattgttgatggggttgtctgatttttcttgtaaatttgtttgagttcattgtagattctggatattaggcctttgtcagatgagtagattgcaaaaattttctcccattctgtaggttgcctgttcactctgatggaagttgcttttgctgtgcagaagctctttagtttaattatatcccatttgtcaaatttggcttttgttgccattgcttttggtgttttagacatgaagtccttgtccatgcctatgtcctgaatggtattgcctaggttttcttctagggtttttatggttttaggtttaacatttaagtctttaatccgtcttgaattaatttttgtataaggtgtaaggaagaggtccagtttcagctttccacatatggctagccagttttcccagcaccatttattaaacagggaatcctttccccatttcttgtttttatcaggtttgtcaaagatcagataattatagatgtgtcgtattatttctgagggctctgttctattccattggtctatatctctgttttggtaccagtaccatgctgttttggttactgtagccttgtagtacagtttgaagtcaggtagcatgatgcctgcagctttcttctttggcttaggattgacttggcaatgtgggctcttttttggttccatatgaactttaaagtagttttttccaattctgtgaagaaagtcattggtagcttgatggggatggcattgaatctatgaattaccttgggcagtatggccattttcatgatattgattctttctatccatgagcatggaatgttcttccatgtgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggtatccctgtcttgtgctgattttcaaagggaatgcttccagtttttgcctattcagtatgatattggctgtgggtttgtcataaatagctcttattattttgagatacatcccatcaatacctaatttattgagagtttttagcatgaaggggtgttgaattttgtcaaaggccttttctgcatctattgagataatcatgtggcttttgtcgttggttctatttatatgctggattatgtttattgatttgcatatgttgaaccagccttgcatcccagggatgaagcccacttgaccatggtggataagctttttgatgtgttgttggatttggtttgccagtattttattgaggatttttgcatcaatgttcatcaaggaaattggtctaaaattctcttttttggttttgtctctgacaggctttggtatcaggatgatgctggcctcataaagtgagttagggaggattccctctttttctattcattggaatagtttcagaaggaatggtaccagctcctctttgtacctctggtagaattcggctgtaaatccatctggtcctggactttttttggttggtaagctatcaattattgcctcaattaagaacctgttattggtctattcagagattcaacttcttccttgtttagtgttgggagggtgtatgtgttgaggaatttatgcatttcttctagattttatagtttatttgcgtacaggtatttatagtatgctctgatggtagtttgtatttctgtgggatcggtggtgatctcccttttatcactttttattacatctgtttgattcttctcgtttcttcttttttagtcctgctagcagtctattaattttgttgatcttttcaaaaaaccagctcctggattcattggtttctttgaagctttttttgtgtctctatctccttcagttctgctctgatcttagttatttcttgccttctgctagcttttgaatgtgtttcctcttgcttctctagttcttttaattgtgatgttagggtgtcaattttagatcttttctgctttctcttgtgggcatttagtggtataaatttccctctacaaactgctttaaatgtgtcccagagattctggtacgttgtgtctttgttctcgttggtttcaaagaacatctttatttctgccttcatttcgttatgtacccagtagtcattcaggagcaggttgttcagtttccatgtagttgagcgcctttgagtgtgtttcttaatcctgagttctagtttgattgcactgtggtctgagagacagttggttataatttctgttcttttacatttgctgaggagtgctttacttccaactatgccgtcaattttggaataagtgcggtgtggtgctgagaagaatgtatattctgttgatttgggttgcagaattctgtagatgtctatgaggtccacttggtgcagagctgagttcaattcctggatatccttgttaactttctgtctcgttggtctgtcttttgtttaaatttgggtgttaaagtctcccattattattgtgtaggagtctaagtctctttgtaggtctctaagggcttgctttatgaatctgggtgctcctgtattggatgcatatatatttaagatagttagctcttcttgttgaatttatccctttaccattgtgtaatggccttctttgtctcttctgatctttgttggtttaaagtctgttttatcagagactaggaatacaacccctgccttttttttgttttccatttgcttggtagatcttcctccatccctttattttatgcctatgtgtgtctctgcacgtgagatgggtttcctgaatacagcacactgaggggtcttgactctttatccaatttgccagtctgtgtcttttaattggaggatttagcccatttgtatttaaggtttatattgttatgtgtgaatttgatcctgtcattatgatgttagctggttattttgctcgttagttgatgcagtttcttccttgcctcaatggtctttacaatttggcgtgtttttgcagtggctggtaccagttgttcctttccatgtttagtgcttccttcaggagctcttttagggcaggcctggtggtgacaaaatctcttagcatttggttgtctgtaaaggattttatttctccttcacttatgaagcatagtttggctggatatgaaattctggattgaaaatttttttctttaagaatgttgaatattggcccccactctcttctggcttatagagtttctgctgagagatcagctgttagcctgatgggcttccccttgtgggtaacccaacctttctctctggctgcccttaaaattttttccttcatttcaactgtggtgaatctgacaattatgtgtcttggagttgctcttctcgaggagtatctttgtggcattctctgtatttcctgaatttgaatgttggcctgccttgctagattggggaagttctcctggataatatcctgcagagtgttttccaacttggttccattctccccatcactttcaggtacaccaatcagatgtagatttggtcttttcacatagtcccatatttcttggaggctttgttcatttcctttttctctaaacttctcttctcactttatttcattcatttgatcttccatcactgataccctttcttccagtttatcgaattggctactgaggcttgtgcattcatcatgtagttcttgtgccattgttttaagctccatcaggtcctttaaggacttctctgcattggttattgtagttagccatttgcctaatcttttttcaaggtttttaacttctttgcgatggggttgaccttcctcctttagctcggagaagtttcatcctctgaagccttcttctctcaacttgtcaaagtcattctccatccagctttgttccgttgctggtgaggagctgctttcctttgtaggaggagaggggctctgatttttagaattttcagcttttctgctctgttttttccccatctttgtggttttatctacctttggtctttgatgatggtaacgcacagatggggttttggtgtggatgtcctttctgtttgttagttttccttctaacaaacagtcaggaccctcagctgcaagtctgtggagtttgccagaggtccactccagaccctgttttcctgggaatcagcagcagaggctgcggaacagcagatattggtgaacagcaaatgttgctgcctgatcgttcctctggaagttttgtctcagagtggtacctgtccgtgtggggtgtcagtctgcccctactggggggtgcctcccagttaggctaattgggggtcagggacccacttcaggaggcagtctgtccattctcagatctcaagctgcgttctgggagaacaactagtgtcttcgaatctcagttggaaatgcagaaatcatccatcttctttgtcgctcatgccgggagctgtagactggagctgttcctattcggccatgttggaactgcccgacttgcttttttcactcgtcttcttacttgatttatccacagctttttccagtagtggtcactcttttcttggaaaacactatttctaatgttgaaaaaagaatcctgtcccctagcttccttctatttttctttttcttttcatttatttatttttttatttttaaaattaatatttttccataagttattggggtacaggtggtatttggttacatgagtactttccttatcattacttccccttattgtctgctctcaccttactcaaatcacttcaaatgtagttctgactcagacaagtagccaaaccctctatgcctactctataccttagcaggcctatgctcagaagctcagcacacactgaccagaaggctctgcaataatgactattctacacatgtatttgttaataatattactttaaagtaatgtgggatataaccctttaaagtcctgtatacatgtacctcattcaatctttataatcacaggaaagtggaattactcttattgtagcaatttactaattggaaagggcagaattgctgtctgttggatgtgcactatatacaggcactatactaggtaatttatgtaagttatttcactaacccttccagagcagctccataattagctccatttttaaaagtgaaacaagtaaacatataaaacattaagtgggagtgacagcagcaacattgttggatagaacttttcagcactcatcctcttgtagaaacatcagtttgaaaaacaatccatagcctgagcaacaaagcgagaccccaatctctacaaaaaaaaaaaaaagtaattagcctattgtcatggtatgagcctgtggtatcagctacttgaaaggctgaggtgggaggattgcttgagcccaggagtttaaagctgcagtgagctatagatgatgccactgcattccaacctgggtgatcagagcaaaactctcttaaaaaccaaaacaaacaagcaacacaaacaatgacaattacaaaaaataaaactatccatgaacaaaaatatgttcacaagagtaaaggaatccaggcgagagattatagcacctggacatagcacagaaataagaaaagacacatcaaagagggaaggaaagaaagttttatgttatccatattatccctcccccatgtctcggcaaaaaccatgacattgctcctattttatacatgagaaaattgaggcacataaatgataggtaaattatccatactaatatatctggcctagttaccaggctcaccacagctataggccagtccctatatattgaggttccaggcccctcccatactctggagaagccccagcaccaggctagtccccacagcattagactccatgctggcatccacagacccagcctccaggcctgctagagtgtcagaacaaaactgacagaccccacctccagtttggcttacatggcactaggcatgaggccagcatgcacacaccaaggctctatgctagtattcatggccccacactccagtggaccccgagaccagacctgcttcagtaggccccagcaccaggccagcctatggccttaggctgcagaattaccccccacagccccaggatccaggcttagcccacagactcatccttcaggcccagacacatactaggcttgctcccacagatccagcatccaggccaacccctatagacctagcttccaggccaccaactgcagacttagaatctagtatgccacctgcagacccaggatagaggcctgctacagtgaacccaggctccaggccctttgctgtggataaatgataacaggaaaacaatacttcaaaaaaatgaaacatttgacaaagagatagaaagcataaaagggaaccaaatagaaattctggagcacaatgactgaactaaaaatttctagagaaagctggaaataacaggctcaataacacagaaaaataaagcagtgaccacaagacagattatttgaaattgcccactcaaaagcaacagtaacaaaaataaaagaaaaaggtgatgaaagcatgtgggacttatgggataccatcaaggaaaccagtatgcagttagcactccatatatgcaagttcagcatccagattatcaactaaccacagatcaaaaatatgttttaaaacccaataacaataaaataatacaaattttaaaatacagtataacaggtatttacatagaatttacataatattacatattatgcttacatctagagatgatttaaagtatacatgaatagatatgtgaaggttatatgcaaatagtacacaattttatgtaagatgtatattctaagtctcatggtaactacataaaaagcgaatattagatacacagatgataaagagaaaacaaaacatactggtaaaagtcatcaaatcacaaagacagacagcaagagaggaacagatgaacaaaagaattacaaaagagacagaaaacacaatggcagtggtaagttcttagtatcaaaaattacttaaaatgaaaatagattcaattttccaataaaaaggaataaagtgactaaatagaaaaacaagatccaacttatgttttctacaagagtcacagttcagcttgaaggatgcagataggctgaaagtgacagtatggaaaaacatacttcatacaatgggtaatcacaaagagcagggatatgtctactaatatcaaacaaaatagagattttaagtccaaactgtgacaaaagacaaaaaagcattatataatgataaaggggacaattcatcaagaaggcatagcaattaattgtaaatacatatgcaaccagcatgacagcaactaaatatataaagcaaatattaacagagctgaaggaagactattttgcatttctgcaaaaatgcaaatgcaaaaatagtagcaaatgcaaaatacagtagagaacttcaaaaccacatgttcaacaatggatagatcatctggacagaaaatcaataagaaaacagtggatttgaacaactggctcaacacacatgtacagaacattccatccaacagcagcagaatacacattctattcagcacacacagaacactctccagaatagaccatatgtccagccacaaacaattcttaataaaacatttaagaagattaaatcacatcaagtatttttttttctgaacacaatggaataagactaaataaacatcaacaagatgaaaatgagaaaattcactaataagttgaaattaaaccactaacttctgaacaattagtgggtccaaaaaaggaaaataaaagtcttaagaaaaatgaaaatggaaacaaaacataacaaaacatttatgcagcagaaaagtaattttaagaagggcatttatagcaatgtaagccaacaatagggaataagaaagatctcaaataatcaacctaacctgagacttcaaggaactagagaaagaagaaaaaatgaagctcaacttcagcagaataaagaaaataacacagaacacagcagaaataaataagatagatacaaggaaaagcaatagaaaagattaatgtaactaagagttgcttttttgaaaaagataaactaaattgacaaacctttagctagattgagataagagagaataaacaagcaaaattacaaattaaagacacgacattaaaactaacgccatggacataaaaatggccataaaagattactatgaaaaactatatgccaagaaactggataaacttgaaaaaaatggttaaattcctacaaacatacagcctatcaagactaaaccattgagaaatatgaaatctgaacaaatcaaaaatggataaaaatatcgaattagtaatccaaaacctcccaagaatgaaaagctcagaacttgatagcttcactggttaactccatcaaacatttaaagaagaattaaggtcaatccttctcaaattcttccaaaaaataaaataggaggggagactagcaaactcattttacaaggtaggcatcaacctcattccaaagccagacaaacactcatatatataaaccaaatattattatagctaaagagagagataaccataatgcaatgaaagctgagacttcaacactccactttcagcactggacagttcttccagacagaatatcaaaaaagaaacatgggacttaatctgcaccattgaccaaatggacctaagagatatttacagatcattttatcaaacacctgcagaatatactttttttcccttagcacatggatcattctcaaatatagaccatctgttaggccacaaaacaagtcttaaaatatacaaaaacattgaaaaaatattaagcatattctctgaccataatggaaaaaatgtaggatttgtaacaagatagattttggaaattatatgaataaatgggaattaacaagttcctgaatgacccatgtgccaatgaagaaattaagaagaaatttgaataatttcttaaaaaaatgataatggaaatatgacatacctatggaatacaacaaactgagtaataaaatagaagtttatgattataaatgcctgcactaaaaaagaaagaaaacttcaaataaataaacttaaagatgcatctttaaaaaattaaaatagcaaaagcacataaagccaaaaattagtagaagaaaataagtactaaaaatcagagaattaataaatgaaattggactcaagaagacaataaaaaagattaatgaaataagaagtggtttttctaaaaaaaaattaaacaaaattgacaaactttagccagactaaataaaaagaaagagagagagcatttccagctaaataaaattagagatgaaaaaggagacattacaactgacaccacagaaattcaaaggattattagtggcttttatgagcaactgtatgccaataaattagaaaatctggacaaatttttagacacatgccagctatcaagattgaaccatgaagatatccaaaaccaggatagaccaacaataagtaacaagattgaagatgtaataaaaagtcttcttggaaggaaataataccaaacctagtgaacttattctgaaaactagaagaggtaagaatgcttccacatttattctatgaggccagtattagcctgatgccaaaaacagacaatgacatatcaaaaaagaaaaccacaggccactatcactgatgcatattgatggaaaaaccctcaaccaaatattagcaaactgaattcaatagcacattacaaagttcattcagcatgaccaagtaggatttatccctggaatgcaataatagctcaacatatgcaaatcaatgtaatatattatatcaacagaatgaaaggcaaaaaacattatctttccaattgatggtgaaaaaacatttgataaaattcaaatgacttcctgataaaaaccctcaaaaaactggagatcaaagtaatatacctaagcataatgacacacaaatgggaaagaccaacagctagtatcataccgaatgggaaaaaaatgaaagccttttctctaagatctagaacacaaaaaggatgtccactgtaaccactgttatttaacatagtactagaagtcttagctagagctatcaaacaagagtaagatataaacggcatccaaattgaaaagtaataagtcaaattatccttttttggagatgatgtgatattatatttggaaaaaatgtacagactccaaaagaaaactattagaactgataaacaaattcagcaaagttacaggatacaaaatcaacgtatagaaataagtagcatgtttatatgccaacagtgaacgttgtagaaaagcaattaaaaagtcatctcatttataatagttatgaataaaaagtacctaggaaaaaacttaaccaaagtagtaaaatatattagcgatgaaaattataaaacactgataaaataaattgaagaggaccaaaaaatagaaagatatccatgttcataaattagaagaatcaatattgttaaaatgtccatactacccaaggcaatctacagatttaacccaaccactatcaaaatatcaagaacattcttcacagaaatagagaaaataatcctgaaatttatatggaaccataaaagatgcactatatccaaatctatcacaagcataaagaaaaaagctggagaaatcaaattaactgactaagttataccacagagcaatagtaaccaaaaaagcacggtactggaataaaaatagacacatagaccaatgaaacagaatagaaaacccagaaataaatctatacacctacaattaactcattttcaagaaagattttaagagcatacattagaataaggacaatctcttcaacaaatggtgctgggaaaactggatatccatatgcagaagaatgaaactagacccctatctctagacatatacaaatcaaaatgaatgaaagacttaatgctaagaccccaaactatgaacctactacaaaaaacttttgggaaactctccaggacatggaagtggacaaaaaccttttgagcaatatcccacagacacaggcaacaaaagaaaaatagaaaaatgagatcatatcaacataagaagcttctgcacagcaaaggcaacaatcaacacagtgaagagacaatccacagaatgagagaaaaatatttgcaaactacccatttaacaagagatcaacaaccagaatatataaggagcttaaacagttctataagaaaaaaatataataatattattttaaaatgggcaaaagatctgaatagacattactcaaaaaagacatacaaatggcaaagaggtatatgaaaaggtgctcaacattactgatcatcagggaaactcaaatcaaaagtaaaatgagatatcatttcaccaaatgccagatgtggtggttcacacctgtaatcccagcattttgggaggctgaggggggttgatcatctgaggtcaggagttagagatcagcctggacaacatggtgaaactccgtctctactaaaaatacaaaaaattaactggacatggttgtgggcgcctataatcccagctactcaggagaccgaggcaggagaattgcttgaacccgggaggcagaggttgcagtgagctgagaacacaccattgcactcagactgggtgacaagagcaaaactccgtctcaaaaaaaaaaaaaaattcttttatccaaaagacaagcaatagcatatgctgtcaagaatgtgaagcaaaggaaaccctcataaactgttggtgggcatgtacattagtaaaactggtatggataacagtttggaggtcccataaaaaattaaaatagagttaccatatgatccagcaatccagtgcctagataaataccctaaagaaaggaaatcagcatactgaagacttatctgcagtcccatgttttttgcagcattattcacaaagataaattcttaaagacaataaggtacatatacaaaatggagtactattcagccacaacagataatgagatactgtcatttgcaacaatttggatggaactgtaagggattatgttaagtgaaacaaggcaggcacagaaagacaaacatcacttttctcacttatctgtgggtgctacaaaatagaacaattgaattcatggatatagagtataagaacggtttaccagaagctggccagagtacttagggttggggaagagatgattaatgggtaccaaaaaaagttaaaaagaataaataagacccagtatttgctaaaataacagggtggctatagtataaacatgatttaattatacattttaaaataatttagagaggtggagcaagatggtgaattagaaagcttcacattccatgcccacaacaaggacaccaagttaacaactatctacacatgaaaaaaaaaaaaaaacaccttcctaagaaccaaaaatcaggtgagcatactacctagttttaatttcatgtcactgaaagaggtactgaagaaatagaaaaaatagttctgaattacatataccatgccaccaccaacccaggaagcagcagaatggtgtggagagcatctctgggtgctggaagtgggagaacacagaaattgtgaggcatggaagtccgtgctgtcctgtaaaacaagaaaggaaaaccagacaaatctcagatgatgccccctcatggaaggagcaacagatagtttaaaaagcagggaaatgatgttaagttgtcaaagtgttattagttttctttttgtctgtttgtttgtttatgcaaatagtgttaagttgttatcaggttgaaataatgagttacaagacagtatttgcaatcctcatggtaacttcaaaccaaaaatcatacagtgaacacacatacacaaagcaagaagctaaaaaccatatcatcagaaaaaagcaccttcactagaggaagacaggaaggaaagaaagaagaaagagaagaccacaaaacaacaaaaataaaataaaatggcagcagtaagtccttacatatcaataataatgttgagtgtaaatggactgagctctgcaatcaaaagacagagactgactgaatggataaaaaaacaagaaccattgatctcttgcctacaagaaacacacttcacctataaagatacacatagactgaaaataaaaggatgaaaaaggatattccatgccaatggaaaccataaaagagcaggagttgctgtacttatatcagacaaaataaatttcaagacaaaaactataagagacaaagaagttcactgtaaaattataaaagggtaaaatcagcaagagaatagaaaaatgttaaatatatattcatccaacactggagcacccagatatataaagtaaatattattagagctgaaaaaaaagataggtcccattacaataatacctggagactttaacaccccactttcaccattggacagatcttcaagagagaaagtaaagaaaaattaaacttcatctctactgtagatcaagtaaatttaatagatacttacagaacatttcacccaagacctgcagaacacatattcttttccttagcacatagatctttctcaaggacagatcatatgttaggtcacaaaacaagtcttaaaacatcacaaaattggaataatattaagcatcatctctgaccacaatgggcttaagctagaaattaacaagaagaattttggaaactatgcaaacatgaaattaagcaatatgctcctgaaaggctagctggtcaatgtagaaatttataaggtaatttaaaattttcttgaaacaatggataatggaaagacagtatactaaaacctgtgtgatacatcaaaagcagtactatgagggaaatttatagctaaaagtacctacagcaaaaatggaaagacttcaaatgaacaatctaacaatgcatcttaaagtactagaaaagcaagagaaaatcaaaccaaaattagtagaagaaaagaaataaagatcatggcagaaataaatgaaattgaaatgaaaaaggtaatacaaaatattaatgaaacaaaaagttgtacttttaaaaaattgacaattgacaatcctttagccaggctaactaagaaaaaaagaagattacaaataaataaaatcagaaataaaaaaggagacattgcgactgatattgaaaaaaatgaaaggatcattagtggctactatgagaaactatacaccaataaatttaaaaatctacaaaaaatggacaaatttctagattcatgcaacctgtcatgattgaaccaggaagaaatccaaaatgcaaacagaggacacaaaatcacagaaaaatattttatgttcatggattggaccatcaatattgttaaaatgtctgtaacacagaaggcaatctacagattcaatgcaatccctatcaaaataccaataatattcttcatagaaatttaaaaaaattccaaaatgtatacaaatccccccaacgcacaaaaatagtcaaagctatcctaagcaaaaagaacaaaactgaaggaatcacattacttgacttcaaattatactacagagctatagtaaccaaaacagcatgttgctgtaaagacagacatgtagaccagcagaacagagtagaaaacccagaggaaaatccacacacctacagcaaactaattttcaaaatggtgccaaaaacatacactgggagaaagacagtctcttcaataaatggtgctgggaaaactggatatccatatgcagaagaatgaaactagatctgtatctctcaccatatacaaaaatcaaatcaaaattaattaaagatttaaatctaagacttcaaactatgaaactactggaataaaactttggggaaactctccaggacattggtctgggcagaaatttattgagcaatatcccacaagcacaggcaaccaaaacaaaaatggacaaataggatcacattaagttaacaaacttctgcacagcaaagaatacaatcaacaaagtgaagggacaacctacagaatggtagaaatatttgcaaacagctcatctcacaagggattaataattaggatatttaagaaactccaacagttgtataggaaaaaatctaataatttgatcaaaagttgggcaaaaacaactgaatagatatttctcaaaaaaagacacacaaaaggcaagcaggcatatgaaaaggtgctcaacattattgctcatcagaggaatgcaaatcaaaactacactaagatatcatagcaccccaattaaaatggcttccatccaaaaggcaaaaacaaatgctagcaaagatgtggagaaaagggaacccttgtacagtattgttgagaaactatattagtacaaccactatggagaactctttggaagttcctcacaaatctgaaattgcaccaccatattgatatgttttgactctgtgttccacccatatctcatgtggaattggtaatccccacatgtcatggggtggggacctggtgggaggtgattggatcatgggggtggatatactgcatgctgttctcatgatagtgagatctcatgagatctgatagtttaaaagtgtggcactccctgccttgctctctctctttccttccaccatgtaagacatgccttgcttccctttcaccttctatcataattataagtttcctgaggcctccccatccatgcagaactctgagccaattaacatcttctcttcataaattacccagtctcaggtagttctttatagcagtgtgaaaacggaactaatacacatgatccagcaatcccactactgtatatataccccaaagaaaggaaattggcatatcaaagagacacctgcacttctatatttgttacagcactgtttacaatagctgatttggctaacctaagtttcccccaacagattaatggataaagacaatgtggtacttacacacaatggagtactattcagccataaaaaagaatgaaatccagtcattttcagcaacatggatggaactggagatcatcgtgttaagtgaaataagccaggcacagtaagacaaacattgcatgttctcacttatttgtgggatctaaaaatcaaaacaattaaactcatggacatagagactagaaggatggttaccagaggctgggaagggtgttgagcggctggtggggaggtggagtggttaatgggtataacaatatagttaaaaataatggataaggcctgctatttgacagtacaatagggtgactatagtcaataataacatagctgtacattttaaaatgaagagtgtaattggattgtttgtaactcaaagaattaaatgcttaaggggacagatggactattctgcattaatgtgtttatttcaccttgcatgcttgtatcaaacatctcatgtaccccatatacatatatacacctactgtgtacccacaaacatttgttaaagtaatacataaaaaaataacttaaagagtataattggattgtttgaaacacagaggaaaaatgcttgatgtaattgttacacattgcatgcctgtatcaaaatatctcatgtaactcataaatatatacacctactatgtacccatgcaaagttttttaaaaattaaaaaatgatgaaaaacaagtgctggcatgaatgttgagaaagaggaatccttgtacactgcagctgaaatgtaaattagtgtatagacattataaaaatatggaaatttctcaaataattaaaaataaactaccatgactcaataatcccactagttagtatacatctaaaagaaattcattcattactggcatacctgagagatattgtaggttcagttccagaccactgaaacaaagcaaaaggagcaataaagaaagtaacacaaatgttttggtttcctagtgcatgtaaatgttatatttatgctataacatactctattaagagtgtaatagcattatgtctaaaaaaagtacataggttaatttaaaaatattttatttctaaaaaattgattatggttatctgagcctttagcaaatcattataatctttttgcagaggaggatctctccttgatgttcatggcttctgactaatcagagtaatggttgctgaaggttggcgtgactgtagcaacttcttaaaataagacaacagtgatgtttgccacatcaattgacctttcctttcacaaatgatttatctgtaatacgtgatgctctttgacaacattttacccacagtagaacttccttcaaaattggagtcatcttctcaaactctgctgcagatttatcaacaaagtttatgtaatattctacattctttgttgtaatttccataatgttcacagcatcatcaccaatagtagattccatcttagcaaaccacttttttgtgctcatccataagaagcaattcctcattcattcaagctttatcatgagattgcagcaactaaatcacatcttcaggctccacttatgattctaattctcttgctttttcaccacatctgcaattacttcctccactgaagtcttggaaacctcaaagtcatccatgagagttctcatcaacatttcccagatccccattaatgttgacatgacctcttctaatgaaccacacatatttttaatgacatttagagtggtgaatcatctccagaaggttttcaatttacttcacccagatccatcaaaggaatcactatctatggaagctatagcctatgaaatctatgttttgaataataagacttgaaattcaaaattaccccttaatctatgggctgaagaatggatattgtgctaacaggcatgaaaacaacattaatttcctatacatcttcatcagagttcttgagtgactaggtgctttgtcaatgagcaatattatgaactaaatctttctgagcagtaggtatccagagtaggcttaaaatattcagtaaatcattctttaaacagatgtgctgtcattcagctttattgttcaatttgtagagcacaggcagagtaaatttagcacaaatcataaggtccctaggattttaagaatggtaaatgagtattggtttcaatttaaagtcaccaactgcattagtccctaacaagagagtcagcctgacctttaaatctttgaagacagacattgagctatctccagctttgaaagtcctagatggcaactttttcaatataagactttttcatctatattgaaaatcttttgtttactgtagacccttcgtcaatgatctgggtaacttccttcaacttttacatcagcacttgctgattcatcttgcactttcatgttgtggagattgctcctttccttaaacctcatgaaccaacctctgctaccttcctacttttcttctgccacttcttcatctctatcagccttcatagaattaaagggagttaacgctttgctctagattaaactcttgctaaagagaatgttgtggctgatttaatcttctatccaaaccaataaaactttctgtctattagcaataaggctgtttgactttgttatcattcatgtgttcactggagtagcaattttaatttaattcataaactttttctttgtattcacaactttactctttggcacaagaggcttagcatttgacctatataagcttttgacatgccttcctcagtaagcttaatcatatctagcttttgatttaaggtgagagacatgtgaatctccctttcactagaacacttttggccattttagggttattaattggcctaaatttctattttgttttgttttgggggatagagaggggcaagtagaaggaaagtgacagggaagtggccagtgagtagagcggtcagaacacacattatcgatttcattcactgtcatatgggcatggtttgtggtgctccaaaacaattaccagaataatattaaagataactgatcacagatcacagaagaaaagacttgagaggttagatggtataggaaacaaatcagttgccaccttcaggtgttagaggacctgtcatgaagaatggggaggataagacttgcttagtgttgcctcaggtaaaggaaggaggacagttgtttagaatgtatagagataagactacccacatggtctccaccagtaacacagtctccactggtaacacagtgggtggtgttaaaagttcagtctccccatctagcgttctagaactaaataaagtatactcatggtggaggaggggagttagggggcaccttgctagagcctggcaagggtgaaagtctatgctccgcatccggccattgccacagttgttgtttttcctctggtgtttggttgtagtggagctgtcatttaaaaattttgtgtgttgctgagctgctactttggatggctttttggggggctttttctatgtcctttggcattaccacattgtcagattctccagtatccagtctgggataggtgacgcaaaaagaaaacacaaagaactcactgtgctgtcactccttagatctcaaagatgctagtcattcttcctttctttctccacctttcagtcttcttatccttgttttatatataatgtccagagtatttagctgtactcagtgggaggaatagagaaaagtatgtctacttatctaacctttcacaaaactgtccattgatcaaatgggcaaatgagagagataacaaattcccttttattagagatattcaaacggaattgggaacaatcgatttggctactaatgctatagtagtcaaataaattaagcatcaaatggtgagctgaacagaaagatctcaaaatttatttctaatctatagattctatattaccatgattttatacacatttaatcctttcaatcaagtacttagtgggttctgtatgccaaccattgtgctgagtgctgggcacatagcagtaaataaaaacaaaaaagttctcaattctcacataatttgttctagagaggggagactgacaagtaaacaaatattatcaagataatttcagatataagttgggggagggggcataaaagaccactttaaatggggtagtccacaaagacctctcccaggaggtgatacatgagctagtattttaataaggagccagtcctgtgcaattaaggggagaaggctgcagacagatgaaatagcaatttgcaaaggtgggaacaagtcagttgggttaaatgaacaaaagaaaccaatgtgattttagcatagtagataagtggagagatcatgttggaccttatataccaagataaaggatttttattttatcctgagttagattaaagacacttggagcgttttaagaaagcaacattatctgattcatgtgcagcagatttggtgaacagtgctactcagcagaatacaagtataaaacagttttgcttttcttcaataccttcttgtgatgtcaaatcctttatttgctgagtaacaaatcttttcttaataatgtcttgggcagattccacaactacctggtcacgtttcttattaaatttgacccagtctaaaaatcataatttcatgtcaggtgcaaacctttccctcctgtatcacatgccaggtctgtagcttgaggtgcctaaattgtaaagatgatctagaatcctttcttgtctatctccagtactttggaattgttgtgcatgtgtgtatgtctgtgtgtgtgtgtatgtgtgtgtgtgtgtgtgcatgtgtaggggggctgtgtgaagttctgtagctccctttttctccacttcccttttcaggacccaactactctggtcttgggggaatgggaaaagggaacagggaagtaaaggcaaacatctcctaactgctaatacttgaggttctctctgctggtgttcttgtcttctcaggataattgaataccaatgccttttgagttaaaaaggctcacctctgggtattgggggcttccctactgtttcatttcctaacgtgagaaatccagctccagttcaccctcttcagcctctctcagatgtcactcgcacctgcaaaccccaaagtttcttgctgctggggaacacttgccttgtagcaagccctcttgtatgggacccagcaaagcagctcaagtttagccatcctctggggtgactactagatgcacaggaaacatatttatctttgcaaactgggtaataaaatgttaggtttctttttctattttgaaggctcccacaattgctttgagtgattctcttgtcttgaagaacaccttcacttggctcaagggtaaggacacttgtaccactgacctgtaaaagtgagaaaaaaaaaactctatattgtccattaggccaatgatgcacaagtctcagagtccttcctcctacccgttatatgctgctaacatgctaggtggtaacagaggtacttggatggactgtgacaacgatggtgttgctaccttccagaaagcctttggcagaatatttggtcccagtttttggcaatattctttattgtgaggcactttgcatccctccttcttcttctcctcatcctttctcattttcttccctttcttctttcttttcttttttaaagttccttatctaggcaatcattatcaaagtcagggcaacaggaatattcacattcaccacactgtaatatatttttattttaaaaaacattactctgacttctgtgtagtgaatgaattgtaagggaaaaagtggaagtagggatactattagggagctggtacagtaatccagatgagatgtaatagaagcttggaccaggttggtagcagagttgataaggattagtagtagttagattcaaaatacagttgtgacatgtcaatagaatgcatatagtaacacacaaataaagatgactactaagtttttggcttgaacaactggctggaaagtggtgctaattactgacctggataacaataagagaagaactggtttgggtgaaagctgtgttttggccatgttaggtttaagatgcctattaatcaccaatgagagatatctgaataagaagaatgaaacaaaattagattctcgtgtcactgaggtggctacagcagaaactttataggtatctggctcatcagtaatgagatacccatgtggtatctagttcaacctatgagccagaacttcagtctttccaatgacctatgccatgtttttcttcacaaatgcaaccattctggctcaccataatacctaacaaaaatcttctgtgcaatagtaaataccaatacattgagcaaaaggttcttacaaacctcagtataagaacaccttgagaatggcattactgaatataaaccacccttctttttaactgccttgtcatccacagcatagaactttgctcagctgtagaaagataaaggcatgaagatggtcactggggacagctagagataagacaatctacatagtggggacaggtggacaatgattgccaaataaatttgctgggtgtgtgagagtcaatcaactctacaactgcttcccttattactcctttataagtagtcctggttccaaatatcttccagggtgtcagtttcagataaggtgatcccatcaattaggtcatcaggtacatagagctggaaacttctggcaatattttcaattctggaggccagaaaagcaatagtaaatactattacactgagcaagaggctctggcagatctcaggcaatggaagacctcctctgctaaaagttttctccttgagtatctttctgactatagtgtgttgaatgatgatcccccaaaagaggaaaagtattaagttaaggatctcgagatgagatgaagattatccagataggccctatctccaatgacaaatgtttttataagagacacacagcaagaaggaaaaggccatgtgaaggctgaggtagagattggatttatgcagacacaagccaagaaacacctggagccaccagaagctagaagagataaggaaggtattctcccctagagctttcagagagagtgcatccctcctaacaacttgatttctgacagctacgtaacctccagaactgtgcaaaatatgaatttctgttgttttaagccaccaagttgtggtagtttgttatgttagccctagcaaatactgcctcactttctttatctcccttattaaaacataacatacatgcataaacatatacataagtgtacagctcaatacattttcacaaactgaacatgctcaagtaatcagcacccagatcaatgtataaaagcttcaacaccctagaagtcctccttgtgccccattctagtctacccaccctaagggtaaccgctattagaacgtctaacagcatagattagttttaactgtttttgtcatttatatgaatagaaacatacagtttacattcatttctggcttcctttacttgattgtgaaattattccatactgttgcacatatctgcagaggtttttttattgctgtagagtattcctcatacagaatgttttatttttcttttctttttttttcttttctttttttttctttatttcttctaaaaaaaaaccgggatatatatgcagaatgtgcaggttttttacataggtctacctatgccatggtggtttgctctatctattgacccatcctctaagttcgctcccctcacccccaccccccaacaggccctggtgtgtgttgttcccctctctgtgtccatgtgttctccatgtccaactcccacttatgagtgagaacatcctgtgtttggctttctgttcttatacagaatgtttttatccattttatccattctactgttgctttgcatatgaggagtttctaggtttgggccactacaaatagtgctgttatgaacattcttgaacacgtctgttgatgagcatatttctgttagttagatacctaggagcagaatcagtaggtcatagggtatgcttatgttcagttttagcaggtattgtaaaacagttttcctatgtagtcatacctgtttgcattcctaccaaaactgtatgggagtttcagctgttccacatcctcaccaaaacttgatattttccaacttttcaaattttagtcattctgatgagtgtcagtgttacattactgtggtttcaatttgtatttctttgattactaatgaaactgggcacttcatatgcttattgggtatttgaatacatttaagtcaaatatcttcaagtctcttgtctattttcctaataagttgtcttttgtactaatttgtataagttatttatatattctgcatatgagtcctttgctggatgtattgcaaatatcctctccaagttggtgagttgccttttctctcttggcataacatcttttaaagagtagaagttcctgattttaatttagtttgtgtgataaattttacctttaagaatggggcttttgtgtcctgttttagaaatctttgcctactccaaggtcataaaaatgttttacatgtttttaaaaagatgtattgttttgccctttactttagatctgtatatatctggagtcggttttcagttatggtgtgatagaaattaagatgtagttttcagttgggcatggtggctcacacctgtaatcccaccactttgggagcctgaggcaggaggatcacttgaggtcaggagtttgagacgagcctgggcaacatattgagaccaagtctctacaaatagatttgaaaaaatatatatatctgggcatggtagcacaatcctgtggtcctggctactcaggaggctgaggcaggatgatggcttgagcacaggatttcaaggctgcggtgagctgtgacagcaccactgcacttcagcctgggcaacacaggaaggccctatctcttaagaaaaaaaaaaaagatacagttctccccatatggcaacccaattcacataaaaccatttatttaaaagatcattatttctctgttgcactgcagtgttaccttcagcataaatcagttgactataaatgtgtcgatctgtttctgaattttatattatgctcaattggtccgtttgtttatccttgaaccagtatcaaacagtcatatttatcatagctttgtaaaagaaaatgaaatctggtagtatatgtcttccagctttgttcatcttaaagattgccttggttatttcttgcccttttgaattctaaatgacttttagagtaagcttgaaaattttggtcaaaaatactttttgcttaagattctgttaaatgtatttgttaatttggggagagctgacatctttataatgctgagtcttccaatccatgaatctcctcattcatttacaccttctttaatttctctcaattgtgttttgttagtcttgcaattctttcattagatttgctcctaggtatttgatagctaatgtaaatgtcatctttttttataaatttaaattgccatatgttgctgctatgtagaaataaaagtgacttatgtatactcaccttgcatccagtgaccttgcaaattttacttaattggaataatttatagattcttttgaatgttatacatacacaaatatgttgcctgggaataataacagttttatatatttttctaattcttatgccttttatttttcttatcatattgcactggctataactacagcataatgttgagtggaaatgctgatagtaggcatttgtcatttattcttgatttcaaggggaaggcttttgatacttcatgactaagtgtgatgtttgctgtagatttctgtagatagtctttatgagatcaagaaagttcccttttatatctactctgctaatagtttttatcttgtatgggtgtttaattttttcaaatgtttttctgcatctccttagatgatcacataatttccaccttttaatgttaatgattttgaatgctaaaccacactttcattcctagaacaaaccccacttgcttgtgatgcattttcctttatataaagctagattcgatttgataatacttttagtgtctcagcatctatgttcatgagagggcactttgtagatgtgttttcttgtaatgtccttactgctttgttttccatgttgatccaatggcacaataactaagtcaatgaagcataccctaagaaaggctgtgtcatccttggaatgttaggccttactctataagcatctttggactcccacacttcctgcctcaggctcaggaacttgatcagtagagggctttgcctttatgttagtcactctctttccctacctcttatatggctaatgagaatgctaggctcttttgaaatctcttgtgttgattttctccctcatgtaggtagggagagggtgaaagggctactgttcttagtcctgtcttctgtgtaggggagcccatcttctttttggggcaatattgaggttgggttaggttatcccttgcaaacttcctacgtatcctcccctgaaggattgcacctgagtcttaccctcaggtttcagtcaggtagtccgaagtaaagagtttttctgaccctatttcaccaaagggaagcctggcctgagggcagactagacaggcttggctcctttctgatgtatgtgacctatcttggtctaagtgaaaaagctgaggcttcctgcttactctttctccacctagctctctcttaaagctaatggagttatctctcaagattaatgaaactccttacttgaagaggtttgctaatcttgatttttccccacatagtgatgtcagaacaccttttcacttcaaagtcgaagatcacttctgaacaaacaagcttatttaattgattgagaaatctaggagggttagagtatagtttaagaggctacataggtagggcaagaggaggctgacttgattcaagaagggttgaagaagtttcagtggcttgttattaagcccaagctgctaaactacacttgccattttggctggtgatttcagggtctgatttacacggtggaggtctggcaggtttcttatgctcatgagtaaccccggaatgtttaaaaagataggaattatggaaggtttccctgcctgtaggtcagctgatctgttagatcttgctattggggaaggaaactcacatcttctgaacacctatagcaccctgcactgtgactcttattttatgtctatcttatctacatctcacaaaaactgtacatgtacgtattattgtcctagttttacaaaagagaaaaactgaagccctgatggcatgatgcaaattgcccaaggtcatctaattaagaaatgggatattaatttgattccacttgtattgaatttcaaaactgtgctctattggaacaggctgtgtttggttataggcaacagaaaatcaactcagtttaacttagacacaaaccagctaaacaaaaaggcatttattggctttattttaggaagaaattgctggaataatctaggaagaagtactagggtaactcatggaattgaagagctgtaggaaccaagattttggtgagtagaactagggactcaaagctgctaggatcctccttttccctgcatatctcttatctttgcttttctatgcaaatttctttcatgctctcttacttcagacagggttttgtccacttggcaggaaacatggctgacaagagcctcatttcagcaacttcagtgggtaaaaaacttcctttttcctagaatctacatatctcagtaaaggactgagaattgggctttatcaatcactgctgccagagaaggtgggatatcttccttggcaaaacctaaatcacaagcccacctagatttgcgagaatctgttacaagaaaaaggagaagaaaggaaggacagattacaaaaaaggaattcccacagactattaattgcatttgcttttcctactcactagggactactgcagagtttgacaagctttttttcccaagggtcagattgtaaatgtttttaggctttgtaggccacatactgtctcttttacttcttcttcatcctccttttcttctccttgcaatcctttacataggtgaacaccatttttagctcataggccatatcaaaacaggcctcaggctgaatatggtttggctggccagttttctgagctctggtttagtgaagttaagtaaggatccaggtctgagccattttgaaacagagcatgctacagtatcttaggatccagtcaactacacactgggaatgttcaaacctgtagctaaattcattaagtgaaataaggtagatgctttagtgagcaaggcaagaggaaactaacattggagtgcctaattggtgtgaagtgtcatgctaggcattttatataacataatctcattgagtcttcacgatatatttgtgaatcagatactattattattcttgtctgagagatgaggaaactgagactgagagaaaagttacttgtttaaagtccacctagccagtaagtgccatagccaaggttcagacacaagtttctgtggctaccaaaccaaaatactttacagtaattttagcatgtcagctgcaggttctgtggttggtgggttggggaggtggttcagtctagcaggcacatcaacagcaatagttgatacctccctagggtcacaaaaggatggtagtcgtaattatctttgggcatcacatctgtttcaatgaagtcacctggtatttttacagtttcttatattacactgacttttaataaccaacatggaataccttttcacaaaataatgttagccaaaggtgataggcaaggtgttttaatagataacaaagggtagttgcttcaatgttaatagaattttattcctttgagctcctatggttgtgtgctacattgatttgtggatagggagatttaacccacagtagattttgaaacagcagaatattgttttgatgaaggaatatagccaggtagaccccttcttactgtttttctgctcccccatataagagaaaacttgaagtagatagcagattgacgttatgctttcaggagtgtcttctttggacaatgataaattggtagcctttgaaatatgtccttccaaaaataaactagtacataccttcacaagtcatctgacattagttttctgctttatcttttgaggtctggcaggggccactaagtgaagaaaatgaagaaaacttatttactgtgtatctactacgtgtcaggtgctttcctaaaataagtttgtaagttacatagtatgattatcccattttaattaattttaatgattcttagtgtatgctaaacctttcacacccccatttatgaagaagttgagactcagagaaaggaagagattttctcaaggttacacagcttagcagatccaagatgatgatctcaagttagacacacaaactctgctcttttcccaatataccacactatcagcaattgttcactggtccctacaactcctggactagggcaagaaatagagtttatatttatgaagtttcaacattagcattttggcctatgggggtttctggagttcttcattatagggatttggagtacaatgagtcatgaggcattttttggcatgtaacataccttttttgaagatctatttatcccctgtaagctaatgctttttcccacagcatgccatgcgaaataattgtccccagtcaacccctctaccctggcttggtcctctcacagttctcatgtctgtacttatggtgcatcccaaggtgaagcctgtaaagtttctcttaagaaaggtcccaggcccttccctagggcctagaaaaataaaattttattttaaggtatattatgcataaataaaagaagcagaaacagagggaagcaatatgaatgagaatatgcaataatagataatagcttgcttgcttttctctctatataaacactatagtttacttttgcctgttttttaaagtttatatgaatggaatcatatgctatgttttcttttcttgtctcattgctttcactcaatattatgtgtatgagattcattgaatatattggttatggaagttatgcattcattcatgttgctaatcattttattgtacaaatatagacaaatatagcatattttatgaatttatgtgtcctccttatataaggacgatgctaatcatctattcatttttccaattttagtttatgtgctgtgaaagtgagcatgagccttggtttcttcatctgaaaagtgtagataacagaactagttaactcatcagtttgttgtgagaattaaataagacaggtataggtttagcattcatagtgcctggttggttttctattatttccacaatgagaggctttaatatacagagtatgtggttttggagccagagatacttggcattgattcatagttccattgtttcttgcttttctcaagtctcagtttgcttgtctgcaagatagagatgagtaatattccacaaccaagttttgtcataggagttctgttaaaaatgcagaatatctggcacatggtaggcacttggcatagtttgttgatctgtacttcatttttaaaaagtattctaaactgtagtgtttagaaatcacactggtgatgtgagagtatcgatttctcagtttaacatggagaaatagaactggaactctgtgtgtatgtgagtgtatgtgtgtctgtgtgtgtgtgagagagagacaaatacagagtgagagagacagagagagagaaaaggggagtgaaagggagaagtgattcaaggagaaatagtgaggctgttttcctgtgtgtggctttatagtcagagaccttgcctagacgcatggaggaagaacctttgtgaaatacagcctataaaagtaattttaaaaaatgctaatccaggatgtagtttttccctaggtgggggttctgatgagttgtttgtgtgagaaaagtgtagttattgctacatttgtctcagtgtgacaaccggacatgaattacacaccacccaatgcgaaaagttacccttggaacacatgctgactaatcagaaacaattttgccagatgttattaattgcagaaaagctcccctttcctcctcaggaagttgactcaaccctttcagaactttctgtttgttttgatggctgacaaggagagtgaggcatggaactattttatatcctcccaaataatttctatcctagtaggatgggttgtctattgtgcttcttttgtgtcctagaaggcaggacctgaaccttatccaccgagctgggtgatccttaacaaacatcaaatcctgaagatagttctggctttttgtctacacttttcttctcccattatcccccctaccccttgctgtacccaactccactttatctcccagacgtgaataaaacagctacggagaagccgtgatatcactgagtataaaaggctaaccaatggccaaaggaaggctggactcttccattagctcacttttgataagtcacttcctttctctggacgtcagttttaccatttgtcaaatgggaataagacacttcccagttctcacagggtcgctgaggaaatatgcaaaacaagttgtgcaaactgaaagccttcagtatatgtaaggcataataaaaacaaccaatacttattgactcattaagtgcttactatgaactaggtactcttctaaactctttattcacaatattttacttaatcttcccaacatgaggcaaatatgatttccatcttaaatgtatggaagaattaggtgaggctgagagaggtgaagtcacttgcccaaagtcatatggtctagtaagtgggagagctgagtttaaagccagaaaattggactgtctctactcttaaccagcttgctattctgtctctttgctgttattactacattactcatgcattctcatttgctaaatttcaattcaagtcccatcccttcagaaagacttgtctaaccattccagccattagctaaatatcccctcctgagttttttaatgatgctgtgttactaatttgatgcctagcactattgccttatcattccaaacatacttctgcttgagtttttcatagatgttaagctcatttgttcagatatattgtaagcttactgtgaaagcatattatatctcataccttggtatcccccatagtattgaggataaggtagaatgaagaactctcagaaacagaagggctctgaaagattttttagccaaggctctctttaaatgatggtctgactatagcaaaataaaaaagtaatagaaacaggatgatcatctttcttgcacctaatggtgtacatttttattagtgcagctcatgagtggttggttcattcatgcatttctttgactgacaatattgtggtattatatgttatgataagcagtgaaacaaaacagagtgaaaacagaaaaggatcataacaaagtccctgccctcaaggagattacaacttagtaagggaaggtggatatgtatattagtacatgggacaacatatttaagaaaatatttaagtatttaagtaaatatgtgtaggaagagtggggaaacacaaaactggagcaaaaggtaaaggagccatggaaattttcctggaagaggtgaatctggagctaaatgttggccattgagtacatgcttattagaaggccaaggtgagggagcatttccagtagagaaagtagcataagctatctgacatggaagtgtgaaatcattgaggtccttacatatcacactaaagaatttggattttattctataatcattaagaagacagtagaagactattctagcagcagttagagaatggactaaaagggaacaaagctgcaggagacagggagaccaattaaaagaccagatatatgaagggagaactaattagaatactatgtagatgaaggtcttaactaaggcagcagcacagaagattgggaggaaaacacaggcaggacatatattaacaagagagaaaaagtagggcttagttgctagctgaacacgtggagggtgaataaaagtgagagatctaagagtatgaatgtgcaggtttattacagcttaggtgactggataaatggtggtgtcattcaccgagattgagaacccaggatgaaaaacaaaattggaggaaacaaccatgagggtaggtttggacatagtgagttttagatttctgagggtatgcaggtagatattttaagtaggcagtcagttatatggaactgaagtcaagagaaaagactgggcactatgtcatttaaccctcacaaagactttatgatttaggaagcaaatttgacccctttttactaatgaggaaaacaaggcttagaagaggttaagtaattcacacaattagtaagtggcagagccagatttaaacccaggtcagtcctgctttaacacctgcatgcttaatcattgctgtaaataaagtactggcagtggatgggattgttgaaggtacatgtatagattgcaaaaataagagggtcaataggtgaaacttctaggcacaacaaacttttaggtgtatgaagaagaaaagactacagatgggattgagaaggaactatcaaagaggtaagaggagaagccggcatgagaagtatggcagaagctgaaagtagacaacagtcaaaggccatggagcaggggtcaaataagcaaggttgttgcaaagagacctcaggatccagcaataaggaggttgttgatacctgctagagcactctcagaggagtggtgagagtataatctggaatgcagcagattgtaaagtgagggaattgatagactgacgtgatacccttttgaggtgcttatcagtaatgaagaagggaaagacagggtggcagtctgagaaagatgcagagtagagggatatctttttccaactgggaagtggttgggtggagtgggatacatggtttgaggagtgggcaaagatacagaatatcgaatatggggaaaaaaacaagggactgaccaaggacgcattaaaaatactgccaagtgcagcactaaaggcctcacatggatttgtaggtgccctaatgtgccttgttccatgatagctgtaacctcacttaacagctttattgtgggaaggacaccacaccaaatttgttctcaaactttttccagcccagtgctcctgaagggcatgacatgaataactaacaatttctgtgcacttaccatctccaaagcactgttttaaatgttttacatatgttaactcatttaatccttgcaacaaccatagagtttaagcgtctattttcattccaattttacaagtaaagaaactagaatgcagaggatatgtataatgctagcaaactgaggagacaggatttatacagaggtggtctaagtatgattccatgcttataaccacaatgctgtgactatgagtcactataaggcagtgattatccactcaggctagagtgggtgtggagtttagctcccacttacaagtgagaacatgcagtatttggctttctgttcctgtgttagcttgctgaggatgatggcttccggcttcatccatgcccctgcaaaagacatgatctcattcctttttatggctccatagtattccatggtgtttatgtacatattttcttcatccagcctacagttgatgggcatttatgttgattctatatatttgctattgtgaatagtgctgagatgaacatatgtgtgcttgtgcatttatggtaaaacaatttacattcctttggatacatacccaacaatggattgctgagtctattggtaattctgtttttagttctttgaggaattgccacactgctttccatgatggctgagccaatttatactcccaccagcagagtataagcatgttcttttctttgcaacctcctaagcatctgttattttttgactttcaataatagccattctgactggtgtgagatggtatctcattgtggtgttgatttgcatttttctaatgattagtgatgttgaccactttttcatatgcttgttggctgcatgcatatcttcttttgaaaaacgtctgttcatgtcctttgcccactttttaatggagttgtttgcttcttgcatgcaaatttgtttatgttcttttagattctgaatattagactttttcagaagtacactttgcaaaaattttctcccattctgtgggttgtctgtttactctgtttgatagtttattttgctgtacaaaagctctttagtttaactgtatcccatttatcaatttttgcttttgttgcaattgcttttggcatctttgtcataaaatctttgccagttcaaatgtccaaaatggtatgtcctggctcttcttccagggtttgtatagatttagattttacatttaagtcttttatccatcttgatttaatttttgtatatggtataaggaaggggttcactttcaatcttctgcctacggctagacagttatctcagcaccatttattggggagtcctttccctattgcttgtttttgtcagctttgttgaaggccagatggccgtaggtgtgcagaattatttctgtgctctctattctgttctattggtctatttgtctgtttttgtatcagtaccatgctgttagattactgtagccctgtagtatagtttgaagttgagtaatgtgatgcctcctgcttgttgtttttgcttagatctgccttgtctatttgggctgtttgtttgttccatatgaattttaaaatagtttttcttctagttctgagaggagtgttatttgtagtttgattatttgtagtgttatttgtatcattgaatctttaaattgctttgggcagtatagacattttaatgatattgattattcctatccacaagcatggaatgttttttctatttgtttgtgtcatatctggtttctttgagcagtgtttgtaattctcattattgagacagtttacttccctagttagctttatccctaggtattttattcttttttgtgggaattgtgaatgggtttgcattcctaatttggctcctagcttggatgtttttggtatacagaaatgctactggtttttttttatgctgactttgtatcctgaaactttgtcgaagttgtttttcagatccaggagctttagggcaaagactatggggttttctggatacagaatcatgtggtctgcaaacagggatactttgacttcctctcttcatatttggatgccttttatttccttttcttgcttgatttccctggccagaacttcccatactatgttgaataagagtggtgagagagggcatccttgtcttgtgccagttttcaaggggaatgcctccagcttttgcccattaagtatgatgttggctgtgtgtttatcatagatggctcttattattttgaattatgttccttcaatgcctagttttttgagggtttttaacatgtagggatgttggattttatcaaaatataaatgctgtttttgatgaggtgttcagagaaagcctcaaagtaacatttgaacagagggtcaaatgatgtgaaggaatcagccatgagaataaatctaccagaatagagttcttagcagactaaatagcaagtgtaaagtccatgaagtgggaacatatttgacttgtctgaggaacagcaagaaaaccactgtggctagggcagagtgaaggaggggaagagtcatgctagatgagacttgtgatgtgaacaaaaactagtctttcctcttctataaactgcagataataatagtacttatagagctggagtaaggaataaatgatataatgcatgtaaaaatcctgatacaattccggcacatggcaagtgctcaaaaactaatatatgctatcattgttattattatcaggctgatcatgcctaattttgccatgcaggtggcagagtttgaattagaagtgtaagtcagagcaggagcctcttggtggagcaggcagagacaagagcatgagcagaaatgaagtagccataaataggaagcaagatcgacatacttcactggcgcaaacagactagagtggtgtcacacagaatgactaatatttaatatgagggagaaagactggaacattgacaacagggctgaaaaccattaaatcaagatggctcacaaggagaaggtcactagtctgacagtcaggaggctttgtcttcacatccataaaatagaaaaagtaactacttcataaagttgataagattaatgaaagcacctagcacagtgctgggcatgtaagaagggtagaaaatatagccagctgaaaattgttaagaactaggatgcatgaagagtcttcttgggctagagaatagagaactctgttgtccatgtcatatttgctccacaggtgcaagtctcatttgctagatggcattcatgatgattgcttcacactccctctgttttcatcctcatttgtttcttaaattcatggctttatattctgactgtagtccactgactctgaccccaccagaactcagaattattccacactttctcttcctgtatttggacccctggcatgccattttggttttgtatgcacctctggtctcctgtgcaactctattgtttaagggaaatatgaggattccctggccttgaagaatctaccctcaatcctactctcttaataagaaaatgaagaaagagagtgcaatgtgggcatctgtccatacaggatcccaccatcatcacaggaccatctcattatccccagatgctcgctgttcccggatccatttaataatgagcttggctcaatattaagcctctgcactccacccccacccactacacatagatttttaactgttttgtacttagggtagaaatgggaaaaggaagatatttatttggcacttcttgtctcaggcaagaattagtctgcactacagggcagataaattggtttaaaaattagtagagtcagctatcaccaaagtcaatagagcagagccaggaggaatgatgcaagagacaagtcattttaacactttctggagctaagtggggcataaaaaatagtttgaaagtactttgaattaggggattcagtttgtgcctaacatctgtccaaacctccttcttgtcctctgagtcagagttaatctgatcttggcttaaaacccctggaaaaagaaattaaccagctaggtcactgctgcttgggaatatattatgccaggaatcagaataatcaagaagaatgcatcagccacgtgattctggaagacttgctgtttgaggttggacaactctacaaaaacgtaaccattagactctgggctctggcaaacagattcccagtccattatacaacactgaggaaactgtacagcattttgagtctgaataaaaaatatattttctgtaaaattatttatttttctgcactccatttaggctatttgtttatgcgtgggtttgatgtgtgtagctatggcttgctaagatagttgaaaaggtttataagcaatgttcacttagatatggaactcatatcaatatgatggcaaagggtctggtatatgttatgttgtgaagagatgcaggattggaatttcaggaaatgatggaattacctaggtctttagaagagagggaagataggagtataaacaacctattttaaattccagtaaaaagtgagaactggctgaagatcaaggcacattggaaattaaccacagatctggggagttacatataacctaagctgtctggcaacttcaaaaagcaactattcctggtgtaaccctactagctgacacttgagacaatataaaatgctgtcaccttgcccttgcactattcctgacagaaaagatctaaggtcctttgataatagtcacttgccaaggtccaagaatagattgtctttcaggtatctatctcactttgttacaaggcaatcatatagacacacattttctggaaggcatgttctggaagaaaataaaaaatcttagaaatattcatgggttttgatctagcaatccccattctgagactccagtctaaagaaacataaaaaaaaacctatgtatttggggagttttgtcagaaaacatttttaacttgcagtatttaaaagaatatttactgttcccaaaatgtcattcaaatgcacgtattgtcattgtttggggatgggaactagttttgcaaaaaaacacctaatgttgtataataatgccccaatgatcttgctggttaaaaatacagtatttttggccacaataaaaaagatagtgggaggaaacttttgaaggtgatgggtgtatttatggcattgattgtggtgatgatttcataggtatatacttatctccaaactcataaagttgtatacattaaaaatgtacagctctttgtatgtcaatcatacctgagtaatgtggttcaaaaatgatatacatatacatttatgcataagattgtttattacagtggtgacgcttttcatagtaacacatttcaaacaatcttaatgtccaataacaggaaaagactaaatgaatcatgttgtgatgcaatattatgcagccagtaaaatgatgtttacatggtgttttaaaaaatgaaattagactatgtttctaatgtaaagttatataaaaattatacaattgtacatatagtataaacttaattatgtaaacacattatgtattgtgcattaatgtatgtatatatacatggaaaacatattagaaggaaatatacctaaacattagcaatgattatcattgtttaacaggattataagtgatttgtattttcttctttattttgtgcatttttcctagaagcagagagtagaatgattgttaacagggtctggaggtggcagggagattggggacatgttagtcaaaggatacaaaatttctattagacagaagtaataaattcaagagatttactgtaaaacatggtgattatagttaacaacaatatattgtacactagaaagttatttaagacagcaggttttaagtgttctcaccatgaataactgaaaagtatatgaggtaatgcacatgttaattagcttgacttagccattccacaacgtgtatctgtttcaaaacatcatgttatacactgtaaatatatacatttttgtcaatttgaaataaattttaaaatagatattaaaataaagaatcatgttactagcaatctcatgactatattatgttttatgaccataaggattttgcagatataataaaggtcccaatttagttgattttgagttaatcaaaagggagatcattctgtctgggcctaacctaaatagacaaaccctgtaaaagcagtaagcattctcctcttgtcttgaaggaagaaaacagacatctatgctgtgaactgcttaaggaaagcagttgattgaaagaactgagagaaattcctagcagacactagtaagaaaacaaggaccacagtcatacaactgcaaggaactgaattctgccaacaacctgaataagactggaagaagatcttgagacctaaatgagaagcacaggattggccaaaactttactgtaatctagtgagacctgagcagagcagaatatccaattaagctgactcctgacacattgaaatggtaacataataaatgaatattgctttaagttgctaggtttatggtaatttgttttgcagaaaaggataactaatgcaacaataatcaaatgaacagctttttttattttattattattatactttaagttttagggtacatgtgcacaatgtgcaggttagttacatatgtaaacatgtgccatgctggtgcgctgcacccattaactcctcatttagcatcagttatatctcctaatgctatccctcccccctccccccaccacacaatagtccccagagtgtgatgttccccttcctgtgtccatgtgttctcattgttcaattcccacctatgagtgagaatatgtggtgtttggttttttgttcttgcgatagtttactgagaatgatgatttccaatttcatccatgtccccacaaaggacatgaactcatcattttttatggctgcatagtattccacggtgtatatgtgccacattttcttaatccagtctatcattgttggacatttgggttggttccaagtctttgctattgtgaatagtgccgcaataaatacgtgtgcatgtgtctttatagcagcatgatttatagtcctttgggtatatacccagtaatgggatgactgggtcaaatggtacttctagttctagatctctgagaaatcaccacactgacttccacaatggttgaactagtttacagtcccaccaacagtgtaaaagtgttccaatttcttcacatcctctccagcacctgttgtttcctgactttttaacgattgccattctaactggtgtgagatgatatttcattgtgcttttgatttgcatttctctgatagccagtgatggtgagcatttttttcatgtgttttttggctgcacaaatgtcttcttttgagaagtgtctgttaatgtccttcgcccactttttgatggggttgtttgtttttttcttgtaaatttgtttgagttcattatagattctggatattagccctttgtcagatgagtaggttgcgaaaattttctcccattttgtgggttgcctgttcactcggatggtagtttcttttgctgtgcagaagctctttagtttaattagatcccatttgtcaattttggcttttgttgccgttgcttttggtgttttagacatgaagtccttgcccatgcctatgtcctgaatggtaatgcctaggtttgcttctagggtttttatggttttaggtctaatgtttaagtctttaatccatcttgaattgatttttgtataaggtgtaagggagggatccagttacagctttctacatatggcaagccagttttcccagcaccatttattaaatacggaattctttccccattgcttgtttttctcaggtttgtcaaagatcagatagttgtagatacgtggcgttatttctgagggctctgttctgttccattgatctatatctctgttttggtaccagtaccatgctgttttggttactgtagccttgtagtgtagtttgaagtcaggtagtgtgatgcctccagctttcttcttttggcttaggattgacttggcaatgggggctgttttttggttccatatgaactttaaagtagttttttccaattctgtgaagaaagtcattggtaacttgatggggatggcattgaatctatgaattaccttgggcagtatggccattttcacgatattgattcttcctacccatgagcatggaatgttcttccatttcttcatatcctcttttatttcattgagcagtggtttgtagttctccttgaagaggtccttcacgtcccttgtaagttgggttcctaggtaatttattctctttgaagcaattgtgaatgggagttcactcatgatttggctctctgattgtctgttattggtgtataagaatgcttgtgatttttgtacattgatttcgtatcctgagactgctgaagttgcttatcagcttaaggagattgtgggctgagacaatggggttttctagatatacaatcatgtcatctgcaaacagggacaatttgacttcctcttttcctaattgaatatcctttatttccttcccctgcctaattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattactttgagatacgtcccatcaatacctaatttattgagtttttagcatgaagggttgttgaattttgtcaaaggacttttctgcatctattgagataatcatgtggtttttgtctttggttctgtttttctgctggcttacatttattgatttgcatatattgaaccagccttgcatcccagggatgaagcccacttgatcatggtggataagctttttgatgtgctgctggatttggtttgccagcattttattgaggatttttgcatcaatgttcaccaagggtattggtctaaaattctcttttttgtttgtgtctctgcctggctttggtatcaggattatgctggcctcataaaaggagttatggaggtttctattgattggaatagtttcagaaggaatagtaccagttcctccttgtacctctggtagaatttggctgtgaatccatctggacctgtactctttttggttggtaagctattgattgattattgccacaatttcagagcctgttattggtctattcagagattcaacttcttcctggttcagtgttgggagggtgtaggtgtcgaggaatttatccatttcttctagattttctagtttatttgagtagaggtgtttgtagtattctgatagtagtttgtatttctgtaggatcggtggtgatatcccctttatcattttttactgtgtctacttgattcttctcccttttcttctttattagtcttgctagtggtctgtcaattttgttgatcctctcaaaaaaacagctcctggattcattaattttttgaagggtttttttgtgtctctatttccttcagttctgctctgatttaagttatttcttgccttctgctggcttttgaatgtgtttgctcttgcttttctagttctcttaattgtgatgttagggtgtcaattttggatctttcctgctttctcttgtgagcatttagtgctataaatttccctctacacactgctttgaatgtgtctcagagattctggtatgttgtgtctttgttatcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagatagtttgttataatttctgttctttcctatttgctgaggagagttttatttccacctatgtggtgaattttggaataggtgtggtgtggtgctgaaaaaaatgtatattctgttgatttggggtggagagttctctagatgtctatttggtccacttggtgcagagctgagttcattttctgggtatccttgttaactttctgtctggttgatctgtctaatgttgacagtggggtgttaaagtctcccattattattgtgtgggtgtcttagtctctttgtaggtcactcaggacttgctttatgaatctgggtactcatgtattgggtgcatatatatttaggatagttagctcttcttgttgaattgatccctttaccattatgtaatggccttctttgtctcttttgatctttgttggtttaaagtctgttttatccgagactaggattgcaacccctcttttttttgttttccgtttgtttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaattttatcctgtcattatgatgttagctgtttattttgctcattatttgatgcagtttcttcctagcctcgatggtctttacaatttggaatgattttgcagtggctggtactggttgttcctttccatgtttagtgcttccttcaggagctcttttagggcaggcccagtggtgacaaaatctctcagcatttgcttgtctgtgaaggattttatttcttcttcacttatgaatctagtttggctggatatgaaattctgggttgaaaattcttttctttaaaaatgttgaatattggcccccactctcttctggcttgtagagtttctgccaagagatcagctgttagtctgatgggcttccctttgtgggtaacccgacctttctttctggctgcccttaacatgttttccttcatttcaactttggtgaatgtgacaattatgtgtcttggagttgctcttcttgaggagtatctttgtggcattctctgtatttcctgcatctgaatgttggcctgccttgctacattgtggaagtactcctgggtaatatcctgtagagtgttttccaacttggttccattctccccgtcacttttaggtacaccaatcagacgtagatttgttcttttctcatagtcccatatttcttggaggctttgttcatttctttttattcttttttctctaaacttcccttatcacttcatttcattcatttcatcttccatcgctgacaccctttcttccaattgatcacatcagctcctgaggcttctgcattcttcacatagttctcaagccttggctttcagctccatcagctcctttaagcacttctctgtattggttattctagttatactttcatctaaatttttttcaaagttttcaacttctttgcctttggtttgaatttcctcctgtagctcggagtagtttgatcatctgaagccttcttctctcaacccatcaaagtctttctccatccacctttgttccattactggtgaggtgctgcattcctttggaggaggaaaggcgctctgctttttagagtttccggtttttctgctctgttttttccccatgtttgtcgttttatctacttttggtctttgatgatggtgatgtacagatgggtttttggtgtggacgtcctttctgtttgttagttttccttctaacacacaggaccatcagctgcaggtctgttggagtttgctagaggtccactccagaccccgtttgcctgggtatcagcagtggtatctgcagaacagcagattttcgtgaaccgtgaatgctgctgtctgatcgttcctctggaagttttgtctcggaggagtacccggccgtgtgaggtgtcagtctgcccctactggggagtgcctcccagttaggctgctcgggggtcaagagtcagggacccacttgaggaggcagtcttcccattctcagatctccagctgtgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccatttcgagcttcctgcctgctttgtttacctaagcaagcctgggcaatggcaagcgccctcccccagcctcgctgcctccttgcagtttgatctcagactgctgttctagcaatcagcgagactccatgggcgtaggaccctccaagccaggtgcgggatataatctcctggtgtgccattttttaagcccatcagaaaagtgcagtattagggtgagagtgacccgtttttccaggtgccgtctgtcacccctttctttgactaggaaagggtactccctgaccccttgctcttcccaagtgaggcaatgcctcaccctgtttcagctcacacacagtgcgctgcacccactgtcctgtgcccactgtctggcactccctagtgagatgaacccagtacctcagatggaaatgcagaaatcacccgtcttctgtgtcgctcccactaggagctgtagaccggagctcttcctattcgtccatcttggctgccactctgatcaaccttaatattaccaataatatgcctccttatgttatacactgaagaaaatacattaccaacgcagtatttctgtcaaaaatgtttaacgagggactaatcattagaaaactatcagacatatctcagttgtgatgtattctgtcaaacaactggcctgaatttttttaaaatatcagtgtcacaaatgacaaaaaaggccaggatactgctttgattaaagaagattaaagagacatgacaactaaatgcaacagacgatccctgactggattttagataagaaaaaaaagacaagtgtaataaaaattattaagacaaatgaggaaatttgaatataggtaatggtgttatatcaatgtcatatttcttgattatgatgatcatattaaggatatgtaagggagtgcccatattcttaggatatacatgctgaagtacttcatgaatacaggtcaagcattatgatgtctaaaattaactctcaactatctcaggaaaaagtataataaccactataaaatacatacacatatacacacacacatacacactaaggcgggaggaaattgggagactacttatgagcatacatgaggaaaaatgctaacaattaatgaatttaggtaaaagatatatggtgttcattggactgttctttcaatctttctgaaagtttggaatttttcagaattatgttacgaaaagaaaataagagatgaaatcatgtatgtaaaatgtgtctactaaagcacctgacaaatagtacacattcaattaatggagatactgttgtcactgaaataaatactcagataaagtcacatacgcagctctctaccctctgaggacccaaaattcagagctgttgaaacatgagcccatgatcttccagtccacttactgcaagagccaaagtatacatgccttccattctaggatgtgcattgcctgaacagtcactagacatttgccatcccaagtccactctgatgtaccttcaagccctgtgataaatgagacccagagaaagtgcctctgtgctgatgatgggaccaggtcattctgctgctgcttgggacatattactgggtcagtcgcagcagctgactactatctactcatattgaaatccaagtcatgagccctacaagagttattcatgggatgaaggtgatatactttcatctgtccctctttgtctaccaatgcccttgccctcttcataatgaaaatcagagagctaaccttgactgtagtgcttggagtatacgagtcaggcagcaaaaaggggaaaggagtgtcaaggaattaaataagacacagccacatatcacagagggccctgtctgtcaaattgaaaaattttgactttttactctaggtcattcttgtcaaattaggacataagtttaccgagcatgcatagcaactgttagggagtattctaatttacttgccatataattttgatatgacactattattcaataacaatagaaactactttaatattttaaaacatacaaggagatattatagattagaatatgaactttaatatttatgataaaacacaaaattacaaagaaatatcatgccttcaagatgtccacttcaggccacatttctaggtctctagtgataaaagttcacaatattttgccattagaggtatcattgcagatgtttaggcaactcacattgtagaagacaggcggagcagaaatattttaagcaggtggacaaaatgacaaaataaacatttggaagatgactctgatagctactgtggaagtaaaagagaccagaaaccacgtaggagattatttgaattgtccaacaaaataaaaagggagctaacccctaaaacagtgtagatgaacatcacaaatactatacatacctgaatataagatgactcctgaatttaagcaatccatcattctcctaagaagatcccctccaaatattttttgacaaacatgaatatgtacaaatatttagagatagaaataaattaaatatcttttattatttttaatctagctacatatataactttaaaattgtatagtttattatctgaaaagaatccacaggcagaatgaatgaatgaaaggacaggtgggcatctagggtggatctggggtaagtctagaatttctagtttggatcagagaatgattgaaatgataatgttgccaatcacttaaaagggaaatatagggtatctgacttttttgaagaagtggagggtgaatttctgaatatgataagtttggtttttaatatattgaggttgaagtgcctggaaaacatgagggggaaatgttcagttggcagttggcaatataggtatggaacctaggaggtattgggggatagaaatgttgtatttattgataagtcttcatggaaatggttgatattattgaaggagtttttcaagtgagaagaggagggatctacccagaatcctagaaaaccccaactctgtgcaggggaaggagtgaaagaaaggagtcagtgaagaagcctgagatgaagtggccagagaaccaggaaaggagaagaagaaccacgaaagacaacacagaagcagagaaaggagattttacaatgaggtaatcatagtgatgtttaattcattgatcatagcaaaaataaaaacatttcacaaaagtggtaaaagcagaagctaaactaaagcaaatatggaatcactggaaagggaaaaagtagacacaatatatagacttttttttttttcctgtaagcttggcaatgaagggaagaaaaaagagaatatcaagaagaaaatgtacagtcagggacagtgcttcttttttgacaggtaacataataattttttaaaatatattgttagtaagaaaaatttcaaataaaaatcaaaagaaatagcatattgaactaccttatagccattacccagtttcaacagttagcaactcatggctacttctgtttcatccgagcccaccatccgttttctcccttttccattgtaatctgaggaaaatccccaaaatcaaattatttcatctataaaatatttcagtatgtatctctaaataaggtttccttttaaaagcctatctacaattatatcacacctaaaatattaatatttcaaatatacgacaagtgtccaaatgttgctcatcttctaacttccatgtgtttattcaaataaggatccaaataaggtccatatgttgcaaataatgtatctcataagtctctttttatatataaattatcagagagtttattttgttttattaaattttaaagataccagaacacatttctatgggaaacaggataatctctatacaaaggatgctgaggatattggatgtgggatggatatggaattacataactatttcttgaacacttacgtgtcaggcactgtgctaagcacttcatatacaaatattatctcactttaattatcatgaacaccctgagaagttattattatcattcttgtattggtctggactatttcagttgatgtgaaaaaaaatcaaattgatttaagcatttaagcagagaaatgaattcactgaccttcatagtcaagttatagaagaacatgattgccctgtttcctgcagtatccccatgcctaaaatagttcctggactaatacagtcactcaacaaaaatttgttgattgaataaactgaaacaatgaaaaggtatatggcttcaggcatgactgtaactaggggttcaaactacatcatcaggacccaatatcttgcagttgtgctttcctctgtgtgaataccactcttattaagacttcatccatggggtggcccctagtagcaagatgtttatatcaacccagattctggtccataaacaagaagtctcttcctgcattgttcaaagaaaagtcttaaattttactggaacaaattgagtcttgtgtctatctctgaaccaatccctatggtacacaccaattgtttaaagagagatccagtgtccgtgtaaggaacaatcactgtggctaagaagataaatttttgaatggtcatgcctgggggacaagcccattcccacagtcaagagtgaaataagcttcccctcacccaaccatgtaggctggaagtggagaaaaggtcgttcctggaggaaaaagacaggttctgctaccagaaggaggaatagaagctgagtaggcagaaacaacaaatgtcccagttttacagaagaggagcttgagtaaactgcccaaaatagcagtagagaagaatggttaggagcataccttacagagtgaccaatctgtattcaacccctcattttccacttcgtggtcatgtaaccttgaacaagtctattattaccctcgtaatcctcagttgatcatctgtaaaatgagggtaaggatagaatctacctcatatgtttgaggtgaaaattgagtagtagtaatgtaggaaaagtacaataatacagtataataatactataatatagtaagcactcaagaataatagctatcaatagcactcaagaataataactattaatattgctcagtcacacaactagtatgggacaaaataatgtactaagctacaaaaagaaatgaaagcgtgcatgggtacatgcccttttatcatttctgtgccatttctgagaagagaacacctggcagagtgtgattatagactgagaaaaagatactaccacgatcagtgcatgtttagaaatctagtgttattgtctaaagggataatcagcacccagtggcagttttcactgatcttaaaaccttcaatatctctccctcaaaggcctgggacctcacctgtcactggccacagtctaaggcttttcatccaaatcatttatatctgtagataccagaaccactgaagtaatgtttggaaaacacaagaactgagccaccttgaccttggaatctacaaagctagcctacaggaaaacaaataggttatttagtcaaatagtcatatagatcttggttaaaactttggctctgcccgtttataaaattgtgaaattcaatttacttctgagactatcagtttttttccatgtgtaataatggggataacaactcttgcctcacaaaattattctgaatattggatgatgtcaacatgtataaagcagcttagtacattacctgcacagaaactgcccagtaagtgaaattttcgtctctactaccatcaaaccattggccatccccttaaggggtcatgtttgttgactttcttacagtcctaccttcacttcagtactgcacatcctttttcagtcttgaaagatacactcatcaagattactcacttgggaaaaaaaagatgagatttgcatagctttgtttgttttttgtttgggtttttaatttttgtttgactcaggatttaaaaactgaaacagtgaagatgacagcagttggttgaagcaacatttcctataagtctacaatatgaccaagggctttgtacttttttaaaatagtcattccaaatatcataaaatgcagtgttacagaaagtcccttgaactccaaaaagctgccccacttcaccagaaagacaatggcccagttctcacctgagtccaaatagagaaagtgacaaaattgtttttgtgtaaattattttcatcttgggcattttttacacttatgccttaatacttttatactttttaaaagtattgttttattttgactgatcagccatcatggtcctgtcaatgaaggattttggtttcccctagagtaagtagaggtgtggaggcagtcaaggcttacctgtacagtgacaggaccagttcagtaaaagtgtatgccttttaaaaatttctcacttgttccagcctacaatacaccaataaaactttgactttttctgacatctgacttcatagaccctggaccagataactgcagatgctaaacctctttttgtgtcttgatatcagacaggcctcttctagagctttttaaaaaaaaaaaaattctttatttttattttttatttccatagcttattgaggaacaggtggtgttttgttacatgagtaagttctttagtgatgatttgtgagactttggtgcacccatcacccaagcagtatacactgcatcctatttgtagacttttatccctcaccccatttccatcctttcccactgagttcccaaagtccatcatgtcatccttatgcttttgcatcctcatagcttagctcccacgtataaacgagaacatacaatgcttggttttccattcctgagttacttcacctagaagagtagtctccaatttcatctaggtcactgcaaatgtcattaatttgttcctttttgaacagaaaaccaaacaccgcatgttctcactcataagtgggagttgaacaatgagaacacatggacatggggaagggaacatcacacaccgggacctgtcaggggttgggggacaagaggagggagagcattaggacaaatacctaatgcatgtggggcttaaaacttagatgatgggttgataggtgcatcaaaccaccatggcacatgtatacctatgtaacaaacctgcactttctgcaccagtatcctggaacttaaagtaaaatttttatatgtatataaattttatatatattttatatataaaatatatgtatatatttatataaatatatataaaaatatatttatttatatatatatttatatataaatatataaatatatttatttatatatatttataaaaatatatttatatatatttatatataaatatatttatatatatttatatataatatataaacattatattatatataaatataaatatatatattccttcttacgactgagtagtattcacgtgtgtatatctcacagtttctttatccactcgttgattgatcggcatttgagttggttccaccattttgcaattccaaattgtgcagctataaacatgcatgtgcaagtatcttttttgtataatgacttattttcctctggaaagataccatgtagtgggattgctggattaactgctagttctactttagttctttaaagaatctccatagtttttcatagtgattgtactagtttacatacccactagcagtgtatcagtgttctccgttcactgcattcgtgccaacatctattttttttttattttttgattatgacgattcttgcaggagtaaggtggtattgcattatggtttttatttgcatttccccgatcattagtgatgttgagcattttttcatatgtttgttggccatttgtatatcttcttttgagaattgtctattcatgtccatagcccactttttgatggaattgtttgttttctccttgctatttgtttgagtttgttgttgattctggatattagtccttttccagatgtatacattgtgaagactttctcccactctgtgggttgcctgtttcttctgctgactgttccttttgctgtgcaaaatctctttagtttaattaagtttcaactacttcccgtcgtttttattatatttgcttttggtttcttggtcataaaattattgcctaagccaatgtctagaagggtttttccaatgttatcttctagaatttttacagtttcaggtgttagatttaagttcatgatccatctttggttgatttttgtataaggtgagagatgagaatccagtttcatttgcctacatgtggcttgccaattatcccagcagcatttgttaaataggatgtccttttcccactttatgtttttgtatgctaagtcaaagatcatataagtatttggattcatttctgagttctctattctgttccactggtctatttatttttattttttttattttttttttgccagtaccatgctgttttggtgactatggccttatagcatagtttaaattctgtcaccacacctcttcaacatagtactgagagtcctaaccagagccatcagacaagagaagaaataaagggcatccaaattggtaaagagaaagttaaactgtcactgtttgctgatgttataattgtttacctagaaaaccctaaagactcctccagaaagctcctagaactgataaaagaattcagcaaagtttctggatacaaaattaatgtacacaaatcagtagctcttctatacaccaacagcagacaagctgagaatcaaatcaagaacccaaacccttttacaaaaaaaaaaaaagaatgcttagaaatgtacctaaccaaggaggtgagagacctctacaaggaaaactacaaaacactgctgaaagaaatcatagacaacacaaacaaatgaaaacacatcccatgctcatggatgggtagaatcaatattgtgaaaatgaccaggctgccaaaagcaatctacaaattcagtgcaatttctatgaaaataccaccatcatttttcacagatttaaaaaaaaattctgaaattcatatggaactaaaaaagagtcagcatagtcaaagcaagactaagaaaaaggacaaatctggagacaccacattacctaatttcaagagcctttaaactcaagtaaacctattgtctttaatctacactgccaactacagagcataaatatgaagtaccagtaaaatgtcagagcaagacctcttgtccgcttttatattagtcaccttgacattccccacagcattgtgctacaaaatgcctcccatcccctcactcagagctatgatttgctgtttccttttgcagcaaaatgccactgtcctctcccacattttctcgtatgctgatattggacatatgctataatctgatgagtttatcctattggcatcacaaaatcttatcatttccttattagaaaggtatcatctttctcacataacataattcagacagcttgcagattctcagagagtctagatcatcaagatggctgacaacccacagtcattacaaagaaggaacaaaacagcagctagataaacagacgttgaataggccatttagggaagaatgctagaatccagcaaggaagttacagagaccctcggatgcacaggagctcaagatagcagcatggagagggtaaaagggcagtgagtgaattaacttggagccatgagcattccccattgttgaagaaaagttaagagacatctacagcagtccacattcctatggaacatacctggagtcctacctacaggagagacccttggcactcatgggccctgagccaagtatagggagctacctgaattctgtacaactgttccagagagggaattcgtgccaggttccacccaccagccaggtcctaagctgctgcagcacagtgccattttgagagtggaaaccacacccaactacatcgtgcccagaagatacttaatatcccctgcattttcacaacccttgggctcaactgacatcccctacatccacccagaggactgcagcatcatgatgccagtaggaactagcagtctgacgatgttgccagcacccaagtgtcttaccaaaaaaaaaaaaaaaaaaaaaggtagtccagcacatcagagaggctaccctcagaaacagggaattggagcatgtgttccccaggacctgagagcaatttatttggggccactgccaccaggagtgattcctccctcctctggcagtgacaccaataggcacccttgaaacttgcccagaagcctggaaactggcccacctgacttgccacagccactaccagtgcctatgcacattgcccagggatctaggactagaaagtccagggtaagatgtcactaccgacaatgcccatgcaccccatccaggggtgaaagaagtggcctatgatggccaacgtcaatgcctgtgtgcaccacttggaggcactaagagaagcttgaccagcctgccatccacaccactggtgtgtgtgcactccatttggaaactctaggactagcctgcctgggacctgaggccatcacagctggcactcaagcatgccacctgagtgccccaaaaccagcctgacgaagccactgttccctgctaccactgctgctggtgcccacatacacaacctaggggactgaggactggccagctgacaaccaataaatgaatgtagtagagttgcaggctacaaaatccacacacaaaatcagtagcatttctataccccaataatgaaagagttgaaaaagaaatcaagaaagcaatcccatttacaatagctacaaagaaattaaatatctaggaataagtctaaccatgaaggtggaagctttctgtgatgaaaaatacaaaacattataaaataaatagaagtggacacaaaaaacagaaagacatcccatgctcatgaactgtaagaattaatattgttaaaacgaccatactatacagtaatctatagattctatgcaatacctatgaaaacaccaatgacattcctcacaaaaatagaaagaaaagcttcaaattaatatgaaaccagaaaagaccctgaatacacaaagcaatcttgggcataaagaacaaagctgtaggaatctcactacctgacttcaaaacatactacaaaactacagtaaccaaaacagcttggtacagttataagaacacagaaagatcaatggagcagaacataatccagaaataaattcacatatttacagccaactgattttcaagaaatgtggcaagaacatacattgggaaatggacactttcttcaatatatggtgctgggaagtctgggatagtcatatgcctaagaattaaagtagacccctatctttcaccatatgcaaacataaacttaaaatagactaaagacaaacatgtgatccaaaactataaaactcctagaagaaaccacaggaggaatacctcaggatatcgtttaggaaaagatattatggtaaaacttcaaaagcacaggaaatacaaaataaaaataggcaaatgatattatatcaaactaaaaagtctttacacagaaaaagaaataattagcagagcaaagagacaacctgtagaatgggggaaaacatataaaaactatacaggcatgaatatctaaaatacacaaggatctcaaataattcaacaataacaacagaaaaacaaataaatccaattaaaagtgggcaaaggatccaagtaaacatttctcaaaagaagacacacaaagagcaaataaatatattttaaaatgccaatgtcactaatcatcagggaaatgcaaagcaaaattataatgagatatcacttttctccagttagaatgcctatcccagaaaagacaaaaaaaataaataaatactggcatagattcagagaaaagggaactcttatataccattggtgggaatgtacattagtaagccattatggaaaatagtatgaaggattctcaaaaatctaaaactagaactactatataatccagcaattctagcactgaggatctatccaaaggacaaaataatcagtatatcaaagagacatctgcatcctcatgtttattgtagctctattaacaatagtaaacataaagaatcaacctaagtttccaccaatagataagtagataaggaaaatgtggcatatatgtatacagttgaatactgttcagtagtagaaaaaatgaaagactgtcatttgcggcaacatgattgatcctgcaggacattatgttaagtgaaataagtcaggcacagaaagataaatactgcatgttctcacttatatgtgggagcaaagaaaattaagttcatagaagtagaaagtagaatagaggttattagaggttggaagtgtggagtggaggagaagataaggagagtttgattaacagattcaaaattacagctagatagggagaacaagttctagtgttgtgtaacaatgaagggtaaatatggttaacaacacttactgtgtatatttaaaaagctagaggagaggattttgaatgttcacaacagaaagatataaatatttaaggtgatggctatgctaactatcctgatttgatcattacacattctgtacatgtatcaaaatatcactctctatcccacaaatatataagtaattattacatgtgaactgaaaataataggaaaaaaatgtagagtcttaagtccttctctgacctactgaaccagaatctgaattttaataggatctccaggtaattaattggcatgaatgtcctgccaggcaataaactctcaacattggggttcgttttttcttactgaacacaaacacacaagttaacatgtaatattagagtatgtgcccttatttaatagtaactaacacatcacaattgtatattattaccagtaagcctattaaacaatacttccggcatgtagtttttatactggcctcttttctaggtttttgcaatatttcttaaagagagatacccctgggaaagtggctcttgagtgttaacattactgggaccaaatttattagctgctatgtgtttctgttagagaaagtgctggaaccatgtaaagctttcggggaaggaaaaaatcagaggtgcataaaaaaagagtagaggatgtgaaaagtagctaaaataaaaatatatactaacagttcaaaacagataaaaaaggtgggttttcagactagaaataaatatttagagggcaagcattagagaaatgatagggaactccggtttccttctgttttacattctcttaggaaaatatggtaaatatatggaatgcatatatctaccatacttcctgtgcccatgacagacatcagtaactgactgtgctggcatgtccagctcaaatgacacaacctaagaatccttctatatagagactccaatcttctaccactaatcaagaggagttgggaaacaagtttctcaatggatgtgttgaggcctatttgaaggatgggtgggcaacacccatctctaggtatacgatatgattgactcaggtacatcagattaggatgtttttgtttttgtttttagctaagtcttggtcaagagaatccaggtactactcattgcaactccaaactgcttccaaatcagagttctacctgaatgtgaagtaagggaataacatggagatgaagttcctctactacattttatccattcagcattttatcatcatcaacatgatacatacgaggcatcagaagtcctagattaagagaattccaagatgatgaaagaagtctcataattcatatggttaacctacaattctgcccctatttttcacattgactacatcaataactaatctacctaataaaattttaactgtggcattctaggatttaaaatgctatctgattctacttatcctgtaatatccctacacaatctagtcttataatatcatgtgacaagaagatcgaagcacaggggaactgtatttctacccaattctaaggaaagctagttcctgataaagccaactatccctgtaagaagtggaactactagcatcaggcttgcctacatggcttgtggcattaccacacaggaacttggcactccatgatggtatggttcaaccaccataaatgagattagctgaagcaaactggagtggggagtaattattggaacacttcaaattccacatcacttatgtaatgggcagccaaaactgccagtagtcaatccataaggctagaatatctggggcataagagttcagcctatcctgagagtccctctaggcagaaaactttgtagtgtttggtaactcagaaaaggcagtactatataacagatatagaaccactcatggaccaccaccccagaacgcatagaatatatgaagagagctactacccaaatcgtccactctacatccaagaaaagagaaacctctctcaaatgttgtggctccaccatagtgccaaaccagtatgctactataattccttcaaaaacctgcaatacagcctgaagacttctggaggctctgcattcaatgtctgtgccacctacctttggactaaatgaagtaattcaactatcaataactatacccagtttttagtcttaatccctaaaaactcctgcagcagtatgatgatgaaatttgggttgtggcagacgcaatcatcaaggtggaatactttgtctcttgcattaggcctccatttccactggagcccttcttcaaatagtattccatatataaaagctactcagtctcttgatatctctatacagcctccagtttataacttagctctggtaaccacttgtcctacaactatatttttaggttcacttccttaccatctaacacatgaagatatttggccagatagagtatctacactgttaaatctccagcagacaagttgaatgtcctatccaccttttcactgtaatttgtctagactaattgtatattctccaaccagaatacccagttgcccagcaaccatggtttctacccttcattacttatttgtaccactgagcctacccaccaccaccactagcctcaatactattattagctattcactacctaaaaagttaccaacaggttctttaaacatatctgccagctaccttccaacaatctaaaaaacaatacaggcatatgatgaggtgggaaattatcccaataagaagttttgtctagctttccacttaacaggaataagccatctgctttgctgaatgccagagattcactattcaggacaaagaagccttcaaccctttcacactctagtttcaattatctctgtccccttagatccagcctagcttccataacttcctgctttgcctgacccatcaatgctttgccttttaccccacagtactacgcccattcccattaacacaaaatggggcactgaagcacaaagtacaagttgagcctcccaaatcccaaatctaacatgctcccaaatctgaaactttttgggcaccaatataacactaaatgctcattggaacattttggatttcagaactttgggtttgagatccagtaaatataatataatacaaatatttcaaaatctgagggaaaaaaacaaatttgccagactggtcccaagcattttgcataagggatactcaacctatatactcttcttcatttctgtcatcttcttggcttctgactcttggcctctatacaccagtgctgacactagaatttggccttcttcaattttatatacctctaggaccttggcattcttacaatgctggtggctttgctcacacattcacttgtttctaattgtattcatttcatttatgtgagcaatatatgaattatttaaaattcaaacacttcagataaaatcctccttgaccaacatctccaatcccaatccctcctccagaaataactactgttacatttaaaaggtatataactttgccaagtatccttccaaacctttctttatatacatacatacttatatacatacttacatatgtacctctataaatttggtcaatgtgtgaggttatatttatttatttttatataaatggcaacattctgaacatactgctcttcaattttttaacctccttatggtgtcttggatatctttctatactacacaatagctttacattttgcatatgactcagattatgaaggtaccagtttgtttaacaattttcctatctatgggcatttacattttctctactgttttcattattgcagtgtaacaatagtgaaagaacatccacatacatatcttattgtgaacattttaaatttattatccagtgccaatattaaaaactgaaaccattgtgtcatatagaatattatttaaaatgttaataggtatctcactcccacttataagtgatgggatcattgggatcccaagcctcagtgtcacataatatacacactaacaaaccttcatgtgtaccctttaatctatgaaaaatagttgaaactataaaataaaatagacactgccaaaatgtaccacaaaatacagctgtagtaattcacactcctgccagtagtatatcagaatatctgttttcccagactctccccatacatggtattgtcaaactttttttaattcaaaaaggtttaattataaaatgttgttttttaaaatttaatttttaaattttgaataattatacatattcatagcatacctaatgaagtttcaatacatacaatgtatagtgattaggtatagggtaattatattagggtaattagcatatccataatctcaaacatttatttatttctgtgttggggacattcaataatctccttctagctgtttgaaactatgtattattgttaactatagtcatcctacaatggtatagagaactaggactcattcctcctatctagctagaattttgtatcttttttcctaccattctggacataggccctggcaaatatttcattatgaaaatgtcaaaagcaattgcaacaacaaaaattgacaaatgggacccaattaaatgaaagtgctgcagtgaacatgtgattgcatgtgtccttttgttagaaacatttattttcttttggatctatacctagcaatgggattgctgagtcaacttgtagttcttttttaagttatttgagaaatctccgaactgctttccacaatggctgaactaatttacattctcaccaaaaatatataagcattctcttctctttacagcctctcaagcatctgttgttttttgacttcgacaatagccattctgactgctgtgagataatatctcactctggttttgatctgcatttctctaatgatcaatgacagtgagttttttttcatatgcttgttggccatatgtatgttttcttttgaaaagtgtccattcatctattttacccgtttttaatggggtcatttattttttgcttgttcaattatttaagttccttgtacattctagatattatacctttgtcgtatgcatagtttgtgaatattttctctcattctataggttgtctatttactctgttgatagtttctcttgctgtgcagaagctctttagtttaattaggccccacttgtcgatttttggttttgcaactgcttttgaggacttactcataaattgtttcccaaggccaatgtccagaataattcaacatcatttttaaatagtccatcgttttttcattgatttgaactgccaacttacagtaaattcccatataaacatgcatctatttctggacttgctgttctgttctctaataatatatatttttaatcccctttgtatctttggtcatgtctaccattttattcttaaagttgtttagctgtgtcctctatttttatttttcaaacactcttgtcaaaaccttgtctattttattggtgtgtttataaaaaggctaagtctgttttgtgctgccataataccacaaactggggagtttataattaacagaaatgtattggctcacagttcttgaggctggggaagttcaaaattgagagccaacatctaaaaagggccttcttgctgtgtcttcccttggtgaaacatggtaaatcaagagaatcagagagagagagaaccaaaatggggttggacttgtccttttaaaagaaatctactcttgcaaatagtgacattaatccattcataagggcagagctctcatggcctaaaaacccttaaaggtcctcctcttaatactattacaatagcaagcaaattcaaacatgggtttggttggggacaaacattaaaaccatataaatagcttttggtcttattgatcaactccatggcttatttatgttttatattttattaatctctaccaaatacaataattccctcttcctacttcctgttccttcaattttaaaaattccttgttatgtatggtgaaaagttccactccaaactctggggccactggaaccccatcccacagacaacagatttcaaaaaagactataacattttagcaacattagcaaaatgttactgttgtgtcatatattcaactcaaagagccagttgctatccagcactatgcttagcccatgaataagcaggaggtcgtacaggagactcaagaacaaagattatttagcaaagaatcatgattggcattatccattccctataacagctaagatatgagttagtgaagtctgtatgcccagaaatctcccaatactgtaggttatatggtggaaaattatgttgttaggagaaaaggaaaaattcaaggtgtggtaggtcatgaagaatgcaatagtaacatcgattattatgtaatttttctgggcctcttctccatctgctaaatgagttgattccttctattctcatccggatgtaaaactgtaagctttctggcctgggaagagggattatatgactattttgatgatcctttatttctagtatatttcttggcatgcaataggttttcaatgatcatccacagaataaatgaatgaatgaataaatgaataaagttttctaagcctttgagatacttttcaaggctgataaatcatggcatgttgatgaagggaaattattggacgttgtataccctgtaaaacctagtactgtgcctggcatattagaagaccttaataaatttgttgattaaataaatgaatgagtaaattaataataacagattcaggaatgtaactcattttccagttctagtactttaatggcaacacactttaaagaacttaatattgtctccccttctctctctctctttcacacacacagcataatattatcctctgtggtcattttgggtacagtgccctgtggaatgtaaattgagaatacagcatgggttatttaatttggacactcatactccatataaacataattacattcagaatgcaatagaactgaaaatgaaaataaatacacactgaagtgtggccgtctaaggcctcttcctctttaattgtgatccagattgtttggaagctagaaatgagtgaatcaaggtagacttagggcaaacaagaggaagtggttcttgacacagtaggatgtaaattcaggtccttgttcccccagcaagctgaacaggtggtgaatattaattgtctcaataagaactaggaaaaacttcaggatgacattgttttcacaggcggttagggaagttttaggtgtgggaattataaagcattggaggtagcacctgtctctactggggcagtgagggaaatcatgaggctaatgagaggaaggatgtgaaaaggtgaagacacttcagaagtcttgtctgagaaggatatggtatacagtttacctcatttcattttagtattgatatattcaaatttctcaatcattttctctatgactttttgtggctttgtcttgaaaaatgattttttttcttgttagagcacttactatgggctagggacagtgtgtggaactggggatggataaagaggcaaaaggcatggccagtaccttcacatactcacagtctacttgggtgacagacatgtcaacaaattattacaatatagtgtgttcatgtaaacatggaagtatgtacaaaacagaaatagtagaggaaagtaataaactgtctgagggggtaagaaaatatttcaaagagtaagttatggcatgaataaggacaaacaggaatttactaggcaaaccaggtgaggacaaggcattatagaaaagagaaacagtagggtcaaaggaacagaaacacaaaatagcaggtatcttcagggaattgcaaaggtcaagggcaggtatgatgccaagagatggtcaggacggggatattatctcgtacctatagaaccattcaaatatttcaagtaagggagttacgttgttagatccaggttttggagagaccattctggcagcagtgtggagaatagatctggaggagtaggtcgacagaatccactgagaatgccattgtaatagttcaggcaatagtaatgagggcctgaaactaggctgtcacaatggagactcagaaaaaaaggaaaaatttaagagctaacgggaaaataaaaacagaattccaccccctcctttaaaatctcctcatttttctctgcctttcatagacagctggcagggcttctccaactttcatatgcttctcaacctactctaacagggcttctacctcctggcaccatccaacttcagtttttgcaaggtacccaatgattttcatgtcaataaagccagttgacatgtttttcagtcctcttttacttcagctctttctttttttttttattatactttaagttttagggtacatgtgcacattgtgcaggttagttacatatgtatacatgtgccatgctggtgcactgcacccactaactcatcatctagcattaggtatatctcccagtgctatccctccgccctctccccaccccacaacagtccccagagtgtgatattccccttcctgtgtccatgtgatctcattgttcaattcccacctatgagtgagaatatgcggtgtttggttttttcttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatatgtgtgcatgtgtctttatagcagcatgatttgtagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgaatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattctgtaggtttcctgttcactctgatggtagtttcttttgctgtgcagctctttagtttaattagatcccatttatcaattttgtcttttgttgccattgcttttggtgttttagacatgaagtccttgcccatgcctacgtcctgaatggtaatgcctaggttttcttctagggttttatggttttaggtctaacatttaagtctttaatccatcttgaattgatttttgtataaggtgtaaggaagggatccagtttcagctttctacatatggctagccagttttcccagcaccatttattaaacagggaatcctttccccattgcttgtttttgtcagctttgtcaaagatcagttggttgtagatatgtggcgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatatttattcttcctagccatgagcatggagtgttcgtccatttgtttgtatcctcttttatttccttgagcagtggtttgtagttctccttgaagaggtccttcacatcccttgtaagttggattcccaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatgtggttttctagatatacaatcatgtcatctgcaaacagggacaatttgacttcctcttttcctaattgaataccctttatttccttctcctgcctaattgccctggccagaacttccaacactatgttgaataggagtcgtgagagagggcatccctgtcttgtgccagttttcagagggaatgcttccagtttttgcccattcagtatgatattggctgtgggtttgtcatagatagctcttattattttgaaaaaaccacatgattatctcaatatatgcagaaaaatcctttgacaaaattcaacaacccttcatgctaaaaactctcaataaattaggtattgatgggacgtacttcagctctttctagagtactctctttacttggcttttgggacactgggtatgcctaaatttcctcccatatttctgtctgctctttctcagtctccattgccagttcatatcctcctacttctactgcatgttttaatgttagaaatcctcaaggctcaggccttggctcccttctcttctgaaactatattatctcccttggtaatctcatctatgttcctggttgcaacaagcaagcttaactaaaattaatataccatctatttcaaaaagcaccattattctatgtacctctaagaaagcaaaaaatacattcctccaattgaactatagtatttcatactccactaatcatctcactgtaccccaaacttgctcttccttatagtatttcaaacttaaagatggtcaccaccattcatttagttgctcaaactagaaatcagaaacctctcatgtcctctatgctctacctcaccacttcctacctttcatttataatcaatctctatgtcctattgcttgtacttcctaaataatccctgtatatatccatttctctgatcttcattgctatgaaccaaattaaagctacaactttcctttcttgatttatctcaaaagcctccttacttgaggtttccccaattctctgatatgcagcaaattgagtgatctttccaaagctcaaatttgatcaagtcacgcccctcatgaaaaaccttcagtagcttcacactagtcttagaaaggagttcaaattattcctgtggcctacatagtccctgcctttcctcatgtcaccttgtcctatgctccataagtgttgaccacacacaggccttttttgaacctcaaatatgttacctttctcgctacctcaggtccttctgtacatgctctctcctccgccaggactctcttctaattatttaattaattcctatttactccacaacattcaactcaaacatcaccttttcagagaaatcttccatgattccagactaagtaatgttctatgctacatgttcttatagtgcaatagtcttctaatttctagaatttaaaattgttaatatctaattaacattagagaattacaaattaaagcaacaatgaaattctactgcacatctattagaatggcacaatactgacaatgccaaatgctattgagaatgtagagcaacagaagccttcattcattcctggtgggaatgcaaaatgacacagccactgtggaagacagtttggcagtttcttacaaaactaaacatagtcttattgtatgatccagcaatcatactactagatatttactgaaatgaattaaagatttatgtctacacaaaatctgcatatgaatatttgttataaatttattcataatcgacaaaagttggaagcaaccaagatatcctttcaataagtgaatgggtaaacaaactgataaatccatacaagataatattattcaacaatgaaaagaaatgaactattaagcctcaagaaggcaaggagaaatcttaaatgcatatcggtaagtgaaagaacctggtctgaaaatgctacatgctatatgattccaactatgtgacattctcgataagacaaaactatactgactgaaaatcagtggtcgtcatggatagtaggaggattaaataggtgaaacacgggatttttagagcagtgaaactgtgctatactattattgtaatagtagatacatggctttatgtacttggcaagcctggtagaactgcacaatacaaagaatgagccataatgttaactatgggcttaagtttaaatgatgtatcaatgttgattcatcaattgtaacaaatatacctcaatcaggcaagatgttaataatagggaaacctgagagtgtggggcaagacaatgagtatatggaaactctgttctttttgctcagtgttttgacaaacctacagctcctctaaaaacataaatctagtagttaaaaaatcatttacaactaaaaatgtaattaatttagtgtataaatcaaagcttaatactgggcttgctactaggatgaaagcttcatgaaagtagttactgtggtagggactgcacctagcataatgctgggaacaaaatagcatatcaggtagaatttgtcaaatcaatagataaattgaggattgatgggatgtaagagttaagggataagcaggaatcaagaattacagtcacgtttttggctttggtgactaatttggtgactaagtttatatctgaggaaagggggaaatgatgaattcagtttcagaagaagttttgatgtgcctgtgaaacatatgataggtattttgatatataggtctggtgttggagaagcagcctgggctgtggacataaatttagtaaccgtcagcttcaggtcttggtttaagctaaataaggggattaaattagtcaggaaataagtgtaatataagaaggagaagaggggtggctggcaagatggccgaataggaagagctccaatctgcagttcccagaaagatcagcgcagaaggcgagtgatttccgcatttccacctgaagtacccagctcataacattggaactggttagaaggtgggtgcagcccacagagggtgagtagaaacagggtaaggtgatgcctcacctgggaagtgcaagaggtcggggaactccctcccctagccaagggaattcgtgaaggcctgtgccatgaggaacggtgcattctggcccaaatactatgcgtttcccatgctcttcacaatccacagaccacaagattccctcaggtgcctacaccaccagggacctgggtttcaaccacaaaactgagcagccatttgggcagaccctgagctagtggcaggagtttttttcataccccagtggcgcctggaacaacagcaagacagaactgttcactcccctagtaaagggtctgaagccagggagccaagtggtctagctcagtggaacccacccccacgaagcccagacagctaagatacactggcttgaaattcttgctgccagcacagcagtctgaagtctaaagttgacctgagatgcttgagcttggtggggggagggggcgtccaccattactgagggttgagtaggtgatttccccctcacagtgtaaaaaagcttccaggaaattcaaactgggcggagcccaccacagctcagcaaagcctctgtagccagactgccactctatattcctcttctctgggcagggcatctctgaaaggtaggcagcagcccctgtcaggggcttatagatgaaactcccatctccctgggacagagcacctgtgaaaaggggtggctgtgagtgcaccttcagcaaacttaaacgtttctgcctgccagctctggagagagcagtggatctcaaagcacagtgctcaagctctgctaagggacagactgcctcctcaagtgggtccctgacccctgtgacacctgactgggagacacctcccagcaggagtcgacagacacttcatacaggagagctccagacggcatttggtgggtgcccttctgggacaaagcctccagaggaagggataggcagcaatctttgctgttctgcagcctccactggtgatacccaggcaaacaggttctggagtggacgtccagcaaactccagcagacctgcagcagaggggcctgactgtttagaacgaaaacgaacaaatggaaaagatagcatcaacatcaatgaaaaggatgtccacacagaaaccccatccgaaggtcatcagcatcaaagaccaaaggtagataaatccacgaagataaggaaaaaccagcacaaaaaggctgaaaatttcaaaaatcagaacacctcttctcctccaaaggatagcaactactcaatagcaagggaacaaaactggacagagaataagtttgatgaattgacagaagtaggcttcagaggtgggtaataacaaactcctccgagctaaagaatcatgttctaacccaatgcaaggaagctaagaaccttgaaaaaaggttagaagaattgctaactacagtaaccagtttagagaaaaacataaatgacctgatggagctgaaaaacacagcgtgagaacttcgtgaagcatacaaaagtatcattagccaaactgattaagcagaagaaaagatatcagagattgaagatcaacttaatgaaataaagcgtgacgacgagataaaaaagaaaaaacaaaaacaacaacaaaaaaatgaacaaagcctacaagaaatatgggactatgggaaaagaccaaacctacgtttgattggtacactggaaagtgacagggataatggaatgaagttggaaaacactcttcagtatattgcccaggagaacatccccaacttaggaagacaggccaaaatttaaattcaggaaatacagagaacaccacaaagatactcctagagaagagcaaccacaagacacataatcattagattcgccaaggtcaaaatgaaggaaaaaatggtaagggcagccagagagaaaggtcgggttacccacaaagggaagcccatcagactaacaactgatctctctgcagaaaccctacaacccagaagagagtgggggccaatattcaacattcttaaagaaaagaattttcaacccagaatttcatatccttccaaactaagctttgtaagtgaaagagaaataaaatcctttacagacaagcaaattctaagagattttgtcaccaccaggcctgccttataagagctcctgaaggaagcactaaatatggaaaggaaaaataggtaccagccactgcaaatacatatcaaattgtaaagactattgacactgtgaagaaactgcatcaactaaccgtcttaatgacagaatcaaattcacaaataacaatattaaccttaaatgtaaatgggttaaatgccccaattaaaatacacaaatggacaacttgaataaatattcaagacccatcagtgtgctgtattcaggagacccatctcatgtgcaaagacacatataggctcaaaatgaagagatggaggaatatttaccaagcaaatggaaagcaaaacaaagcaagggttgcaatcctagtctctgataaaacagactttaaaccaaccaagatcaaaaacgacaaagcaggacattacataatggtaatgggaccaatgtcacaagaagagctaactatcctaaatatatatgcacccaatacaggagcacccagattcataaagcaagttcttggaaacctacaaagagccttagactcccacacaaaaatcatgagagactttaacactgcactgtcaatattagacagataaatgagacagaaaattaacaaggatattcaggacttgaactcagctctggaccaagcggacctatagacatctacagaactctccaccccgaatcaaccgaacatacattcttctcagaaccacatcccacttattctaaaattggtcacattattcaaaataaaacacacctcagcaaatgcaaaagaatggaaatcatgacgaacagtctctcagatgacagtgcaatcaaattagaactcaagattaagaaactcactcaaaacttcacaactacatgaaactgaacaaccttctcctgaatgactactgggtaaataaagtaattaaggcagaaatcagtaagttattcgaaagcaatgagaacaaagacacaacataccagaaattctgggacacagctaaagcaatgtttagagggaaatttatagcactacaggcccataggagaaagcaggaaagatctaaaattgacaccttaaaatcacaattttaaaaaactagagaagcaagaacaaacaaattcaaaagctagcagaagacaagaaataactaagatcagagcagaactgaaggagatagaaacacgaaaaacccatcaaaaaatcaatgactctaggagctggttttatgaaaagtttaataaaatagccagactaataaagaagaaaacagaaaggaatcaaatagacacaataataagtgataaaggggatatcaccactgattccacagaaacacaaaactaccattagagaatactataaatacctctattcaaatatactagaaaatctagaagaaatggatcaattcctggacacacacaccctttcaagactaaaccaggaagaagtccaatccctgaatagaacaatagcaagtactaaaattgaggcagtaattaatagcctaccaaccaaaaaaagcccaggaccagatggattcacagccaaagtctaccggaagtagaaacaggagctggtaccattccttccaaaactattccaaacaatagaaaaagagggactcctccctaactcatttcatgaggccagcatcatcctaataccaaagcccagcagagacacaacaaaaaaacaaaatttcgggccaatatccctgatgaacatcaatgtgaaaatcctcaatgaaatacaggcaaaccgaatccagcagcacatcaaaaagcttatccaccacgatcaagtcggcttcatccctgggatgcaaggctaattcaacatatgcaattcaataaatgtaatccatcacataaacagaaccaatgacaaaaaccatatgattatttcaatagatgtagaaaaggcctttgtgaaaattcaacactccttcatgctaaaaattctcaacaaactaggtattgatggaatgtatttcaaaataataagagctatttatgacaaacccacagccaatatcatactgaatgggcaaaagctggaagcattctctttgaaaatcggcacaagacaagaatgccctctctcaccactcctattcaacatagtattggaaattctggccagggaaatcaggcaagagaatgaaataaagggcattcaaatagaaaaagaggaagttgaattctccctgtttgcagatgacatgactatttagaaaacccaatcgtctcagccccaaatctccttaagctgataagcaaattcagcaaagtctcaggatacaaaatcaatgtgcaaaaatcacaagcattcctatacaccaataatagataaacagagagccaaatcaggaatgaacttccattcacaattgctacaaagataataagatgtctaggaatacaacttacaagggatgtgatagacctcttctaggagaactacaaaccacagctcaaggaaataagagaggacacaaataaatgctaaaaaattccaagctcatgggtaggaagaattaatatcatgaatatggccatacttcctaaagtaatttatagattcaacgctatcctcatcaagataacattgaatttcttcatagaattagataaaactactttaaatttcatatggaaccaagaaacagaccgtatagccaagacaatccttagcaaaagaacaaagctggaggcatcatgctacctgacttcaaactatgctacaaggctacagtaaccaaaacagcatggtactggtaccaaaacagatatataggccaatagaacagaacagaggcctcagaaataacaccacacatctacaaccatctgatctttgacaaagctgacaagaacaagcaatggggaatggattccctatttaataaatagtgttgggaaaactgtctagtcatatacagaaaactgaaactggaccccttccttacaccttatacaaaaattaactcaagattgattaaagacttacatgtgagacctgaaattataaaaaaccctagaagaaaacctaggcaataccattcaggacataggcatgggcaaagtcttcatgactaaaatacccaaagcaatggcaacaaaagacaaaattgacaaatcagacctaattcaactaaagagcttctgcacagcaaaagaagctgtcatcagagtgaacaggcaacctacagaacaggagaaaattttggcaatctctccatctgacaatgggctaatagccagaatcttcaaagaaaaaaaatttacaggaaacaaacaaacagccccataaaaagtgggtgaaggatatgaaagacacttctcaaaagaagacatttatgcagccaataaacatatgaaaaaaagctcatcatcactggtcattagagaaatgcaaatcaaaactacaatgagaagataccatctcacaccagttagaatggtgatcattaaaaagtcaggaaacaacagatgctggagaagatgtggagaaacaggaacactttcacgcttttggtaggagtgtaaattacttcaaccaatgtgaaagactgtgtggcgattcctcaaggatctagaaccagaaataacatttgacccagcaatcccattactggtatatacccaaaggattataaatcattctactataaagacacatgcacatgtatgtttattgcagcactattcacaatagcaaagacttggaaccaacccaaatgcccatcaatgataggctggataaagaaaatgtggtacgtggaataccatgcagccatacaaaggaatgagttcatgtcctttgcagggacatggatgaaactggaaaccatcattctcagcaaactaacacaggaagggaaaaccaaacaccacatgttctccctcataagtgggagttgaacagtgagaatacatggaaacagggaggggaaacatcacatactggagcctgtcagttgtggggggcaaggggagggagagcattaggacaaatacctaatgcatgaggggcttaaaacctagatgatgggttgatgggtgcagcaaaccaccatggcacatgtatacctgtgtaacaaacctgcacattctgcacatgtatcccagaacttaaagcaaaataaaaaaggaaaacatgctcaacatcactaatcattagagaaaagcaaatgagaacaacaatgaggtaccatcttatgccagtcagaatggctattaaaaagtcaaaaaaacgacagatattggcaaggatgcagagaaaaaggaatgcttatacactggtggaaatgtaaattcgcaaaacctgaacaaaaaacattatggaaatttctcaaagtactaaatatacaactacctattactcagcaatcccattacttggtatcttccaaaaagaaaatacatcattgcattaaaaagatacctgcacttgcatgtctattgcagcactattaaatagtaaagacatggaatcaacctaagtgtccatcaacagaagattgaataaagaatgtatggtatttatatgccatggaatactactcagccatgaaaaagaataaaatcatgtcttttgcaacaacatggatgagactggaggccattatcttaaataaaataactctgaaagagaaagtcaaataccacatgttctcacttataagtgggagctaaatattgtgtacacatgggcacagagagtggaataatagacagtggagactccaaaaagtgggagggtgggagacgggtgagggatgagaaattatctgttgggtacaatgtaagccatgcagcctttcaagtgatggacacactaaaagcccatactctaccatttctcaatatacccatgtaacaaaatgcacttgtgccccctaaatctacaaaaaagcttttaaaaagaaaacggtaaaaaataatttaaaaaaaaacaatgtacatacattaaaaagaaacaactttgtgggatttctatattggggatggcaaagacaataaagaaaggggctatgatgtttcacaaaaagaaatagagaatcagaaataagcagtgtcatggcagccaagaaagggatctagtaaagtaccgtagtaatttaaactagggacagtgtacctgggtggagtcttagctctgctatttttactggttatttgacattaaacaagttacttaatcttaaatctgcctgtcttatatgtaaagagaggacactaagagtacctaccccaaaggctattgtgaagattaaatgcattaatacatacaaagcacttagtacaatattttgcacacaagaagcacctaataattatttactagtattgttcccggaatgaggggaaggattctttgaaaaagtttggcagttactgcaaagcgaaggagacagaaaaggtaggtacattttctgtgtaaatttattgaaatccatccccttgtcctccccattgccccagctaggctcactcaggtccttattatctctctcctgggcttgttggacatggagtgaagcaagtaagacatgggttgaggaataggaagtaattgtgtttacctggagaattaggctaattaggggtcaggttgaagaggagtcttgattgcctggtgggtcagttaagacttgatcccataagcaatagagagttctgtagaattttggaacaaaaaatagtattacagaattgtgttttaaggaaaattatcttagtgaaagaaagactaggcatgggaaactaattaaggggcttcccaataatccaggtagagatgaatagtgcctgactaaatactgaagaaggaagaaaatgaagcaagagatgttggggaaattgatgaggttttgcaaaatcgtttttttttgtttttttttttctttttttgagacgaagtttcactcttgttgcccaggctggagcgaaatggtacaatctcggctcactgcaacatctgcctcctgggttcaagtgattctcctgcctcagcctcccaagtacaggcacccgccaccacgcccggctgattttttgtatatttagtaaagacagggtttcaccatgttgaccaggctggtcttaaactttttttttttttttttttgagatggagtctcgctctgtcgcccaggctggagtgcagtggcgcaatctcggctcactgcaagctccacctcctgggttcacaccattctcctgcctcagcctcctgagtagctgggactacaggcgcctgccacagcgcccggctaattttttgtatttttagtagagaccgggtttctccattcacaggatggtctcgatctcctgaccttgtgatccgcccgccttggcctccaaaagtgctgggattacaggcacgaggcaaattcatttattattcaatatcattggacacgtattatatgccaggcatattgaaaggcactgggaaagcaacactcatttaagaaatatttgttgtgtatttatttgggtatgaataaataaagttggggtggactctattgtaagtacagtattaagaacagagaatacttttagaatcctagcagaccaaaacagaaaaggctcatggagatcctcccatattaaccaatctccttccaatttcataaactgagaccacagagaggtcaagtgacttgtcacagaactaatacaaaggcaaagctttaaatgtgaaacaggtctgatctgatttccagtccagtgctcggattactacttccagatctgaagctggaaggtgttaatcaggaagactacagagatggagatggcaagtatgaacagcaagaaactgagggatcggaagaggacgtcttaaactggggttgtgtttttctacattcagaaccccagagttttgcaaacattacagctaaaaaaaaaaaaaaaaaagaaaagaaaaaggcaacatgaaaaagacaacattagaaggtcaaggaatggtgaattgtaagatgtgcatgctaaagcagtgtatccagtcttcgaaggaagtaggtcaggttagaaagttgtgatttctccagtgattctttgcttaacgacagagatacattctgagaagtgcactgttaggtaattttgtcactgtactaacatcacagcatgtactatgatacaaacttagatgtcataacctaggctacatggtatagcctattgctcccaggctacaaacctgtaaagcatgtcattgtactgaatactctaggcaattgtaacacaatggtaagtatttgtgtatctaaacgtagaaaaggtacagtaaaaatatggtatgaatgataaaaaaagatacacttctatagggcatttactaatgagtggtgcttacaggactagacacaattctaggtgagtcagtgagtggtgggtgaaatgtgagagcctgggacattacactactgttgacttcataaacactataaacttgagctaggctaaattttttttaaaaagttatttcttcaataataaatttaccttagcttactgtaactttttttacttttttaaaaactttttgattcatttgtaatgaacacttagcttaaaagggaagcatattgtatagctgtacacaattttttctttatatccttatttttataagctttttttctatttcttaaattatctttttctttctttcatttttctttcctttttttttttttcactttttaacttttttgttaaaaaccgagacagaaatatgcacattagcctagccctacactggatcaggatcatcaagatatcattaggcagccagacgcggtggctcatgcctgtaatcccagcactttgggaggccgaggcaggcgaatcacctgaggtcaagagttcgagaccagcctggccaacatggtgaaaaaccatctctactaaagatacacacaaaaaaattagccagacgtggtagcgggcgcctgtaatcccagctacacaggaggctaaggcaggagaattgcttgaacctgggaggcagaggttgcagtgagccgagatcgtgccattgcactccaatctgggggacaagaacaaaactctttcttaaaaacaaacaaaaaaagatataattagattatagaaatttttcagctccagttccatggtaatcttatgggactatcatcatatatgtggtccatcattgacatcattgatccaaacgtccttatgcggctcatgattatttccctaggaccacagtcagggaggaaaaagatgtactccagcgacctctgctgaattccaaaggctgcggccatagttcctggtgacgcagacagtctgataaaaaactaaaatggcggtgtcgcccgtacacgtcgtgcagcagagcatgacggaaaggactctgctggaacgactggcggcacagacttaaggccggactccactccccaccctctgtagttggggcttcatacccctgagctatgatggcaccttattgtgaaaacgccctgaaagtgcgaagaggtctctaagccacaggtgtggcgatgttgttgtcattaccagggacattccagtaggcggcgatagagggcagtatgagtgccgcaaccacgccctactttttctagagctgggttgttaaatgatagggtttgatagggtttgaggccgagtcagagtttaagaatggtggaatttaaactttaaagctaggagttttcatctgagattcctaccggaaatacacaagggtttgtagcagtggtgaaggtcaggaagtgaattccttgaaatagtatataaaaataaaaacgtaaatttctctgcacttgtagggagagaaggtccatagctttcatcaaagaatttggtgaatccttgccttaggggttggggctccgggccagggacaacatagtataacaataatgcagaactgtagagccagactttctggtttcacatctttacctctctaaatccttcctatgtcatcttaggcaatgcacttaacctgtttcagactcagtttctttatctataaaatgaagataacagctgtgctgactttttaatagacattctgactggcataagatggtacctcgttgttttcatttgctcttctctgatgattagtgatgttgagcatgttttccttttttaattttactttaagttctgggatacatgtgcagaatgtgcaggtttgttacacaggtatacatgtgccatggtggtttgctgcacccatcaacccatcatctaggttttaagcccctcatgcattaggtatttgtcctaatgctctccctcctcttcccccaccccgacaggctccagtgtgtgatgtttccctccctgttttcatgtgttctcactgttcaactcccacttatgagggagaacatgtggtgtttggttttctgctcctgtgttagtttgctgagaatgatggtttccagtttcatccatgtccctgcaaaggacatggactcatccttttttatggctgcatagtattgcatggtgtgtatgtgccacattttctttatccagtctatcattgatggacatttggcttggttccaagtctttgctattgtaaatagtgttgcaataaacatacatgtgcatgtgtctttatagtagaatgatttataatcctttgagtatatacccagtaatggaattgctgggtcaaatgttatttctggttctagatacttgaggaatcaccacactgtcttccacaatggttgaattaatttacactcccgataacagtgtaaaagcgttcatcccattcaagacataggcatgggcaaagacttcatgactaaaacaccaaaagcaatagcaacaaaagccagaatttacaaattggatctaattaaactaaagagcttctgcacaacaaaagaaactatcgtcagagtgaacaggtaacctacagaatgggataaaatttttcctatgtttatgttggccacttatgtgctttcttttgaaaaatgtctgttcatgtattttgcccactttttaattggttatttgtgtttgtttcttgttcagttgtttgagctccttgtagattctggatattagtcttttgttggatgcctaatttgcaaatatgttattctattctgtaggttgtctgtttacttcattgattaagaaattccacaaagttttgctcttcgtctctctttatgtacttgaatagacaacatctattagcagagtgtgtgtcagagacagcccttagcacacttataaggtttatctcattgactcttttcagcatctctctgaagcatgtactattattatctctattttacaggtgagaaaaccgatggacagagaaatgaggtaacttgactaacatcacacagctggcaaagagcagagcttcaataggaactcaggcagtctaattccagaggccatactcttttagcccatacatttgtgttgttttgctttgtgactaaaagccagactctagatctagtttttctgctgagttcaaattccagcattaccactttctagttgtgtgactttgggcaagtgacttcacctctctaagcctcagtttcctcatttgtgaaatggaagaacaatagtaaggctgatgtgaagattaaatgagttatttatgtaaaatacttacaataatgtttgaaaccaggtaagtagtatgtaaatgtctcagttccccaggcaagattggtgggaaatcaaaagtcagtctttttttttttttttttccttgcagctttctaacattacacagaactgccaggcttaaaccaggtttaagtagtccagaaaaaaaaaatgggttatgtagtcttcagcagtccctcatggctgccttctggtgctcactggtcatgtcccaagtggtccatttcaaggctttgtaatccttcagtgccaagtctctaacaggagctcacaatctgatttattatgctatactgcccccttctgtggattataggtaatcagtaactatagggcttacaggctgagtttctcacatgcttaataaatggtagtgattttgttttattagctttaacgctcactcctattagcgtgactcccaacccttaatgttaccatgagcaaactaaaacagggaataagggcatctatcaagggcacataaatagtaagtgatggaagtctggatttgaattcaagctttgataattctcacattcccaacttttaatttttattgtatgtctcttttttaaatatttctgaatatgatcacatataaggactgtctatttcctactttaaaatctttttctcctttaggaagtcttcctgtattctggcatattatattgtacttctatgttgactatttttaagttgtttatggaggcgtgtattatcctctatttttaggtagctgaataaaaagaatgagttttccaattccttgttgaattggtttctagaaaaaatgccatttagtgagaatatactaaaattcaagaaactcagttaaaaggagactggagaagagcactgagataagtaactcatggaccctggtaaagtatacttgataataataggtgtttaaaaaagtcaacatctcaagagcatgatttatttcttataaaagattacatccctcacaatctagctcaatgccttatttatagtaagaactcaggaaatatttgttgaattgccatttagagtttgctgataggcttcagtcaatttcaatcaagtaataatatatttcctctggatagctagaaatgaaaatattctaataagaaagatttgcaggtcatgaaaaatttaaccttttacatgcagacttgtatcttcatatttttaataataagaatcactgcaaagttaataagacagttctgggttttaatgtagtaataataaatatgtaatgttatttgatttttcttattaaagtgagagtcttctataagaataatcatgaggcattgatagaggtggagtcaaagatgtacatatagctttgtgtgtcacagcactgatcaaataatgagtctgaagctcattattatcatatatcataacttattttatttattaatggttttgcctctcttctctaaaaattgagagagatgtggttaagtataatatggaagacagtagcataattgttttctattttgtaaacttaatgggtaaatcaaaagccaagcagctgtttaaaaagtaataattttatcttttagaaaatccttatcaatatcagatgtaaagcagtgtaatgagaagaccactaaactgggagtcaaaagcattttattctggtcccagctcaacttcttgtttgtgtgatcccctactagttccatgctctcctctctgaccttcagttttctcgtttgtaaaatgaagattacaatgcccataaggttttagtgagattcagtgaaactgctttgtcaaagtgttgtacaaattagaaatagtgttatagtaaggcatcggtaatgttttctttttcttgtcaagagtcttctaatgctatcagttattttaacatctgtaacataagacaccacatcagtatcattgtaagctttaatctacacttgaatcacaccggtattaagtcaattgatgatatacaaaggagcagtatccatcatcactccaaaaaattgtgctggtacatattggagagtgcttgctcttagcgtccaaatttatttttgtaaaaaaaaaaaaaacagacatgcctataaacacaacactaagttaaaaatttctatacgccctaggtttaatatgaaagtctacagccctttgcctgtttacttcactacaatgtaacagccttttttcatttcataaatatcctctcatctaattccactctaaataacagtgagttagaactataataattcaaaacagattgcaaagataaatgcttgagaggatggaaaccccattctccatgatgtgcttagttcacactgtatgcctgtatcaaaatatcacattgccccataaatacaaacacctattatgtacccacaaaaatttaaacaaatacttaagaaaacagattgcaaaactaacaggtgtacacaaggaatactaacattactatgtaaccatcataccttctgatatccacagtatccttcctatactaacaattttgtacagctgtctctataatacaaataattatagaaatacaagttaattgtactttaacactgcaatcatgtagaaaagaataagtcttttggatattttgtagttcttttttcctccagatggagatagtctggtaagactccttgcttcatggtagtaatcaaggaaggaagtgtaagaactaagacttaaaggattaattaaacatacataattggaagaaaagacacttcaggctgagagagcagtatatgcaaatggcaatttggagggacaagtaggagggcaggaaggggattaccaactctaagttataggggaactgtgtgatatgaagttgaagaggtggaatgggacaaggccatgagggcctcatacgctatccaaggagtttgaattttatctttaaggtaatgcggaatcactaatgtattttgagttattagtgtgtaaaaaaggtcactctggcttctttgtagagattggttaaggaaaattgagagcagagacaggaaaacaagataaaaggttgttgcagtaacccaggcaagagatgtcatgtacctctactaacaaagtggcaggataggactgaccagacttggcaacagttcagatgtgggggcagctcccaggtttgtgacttcaatgccatgccttttatccagtactcatcacctttatgcaaatgatctccaactatgtttcctgtagcttggtcaaaataatagaacagtcaacttcagtcagcagatggcacattaatcacttgattatttcgggtggtttctccattgaacaacctctacctcagtggattggcattttttacttagcataattccctgtagattcatcaaaattatcttatgtaactatagttcattccctcttattgctgaatagtactccataatttatgtgtgcagcacggtttgtttaaccagtttggggttattaccaatgtagctaatatgaacctttatgtacagttttctatgtagatataaagtttcatttatctggggtaaatattcaggagtccaaatgctatgtcatttggtaaatatatgcataggttttctttaagtttgtttaactgccagtcagagttggtttatttttttatattctcacaagccatatgggaaagattcaatttgtatcttcaccagcatctggtattgtcattatgtttttactttacctttactgttaggtgtgtagtgatatcacagtagaattttaatttgcatttacctattgcccaattatgctaaacatatttttatgtgtgcattttaaaatatttatttatttatttacttatttatttattttatagagacagggtctagctgtgtcacccaggttggagtgcactgacatgatcatagctcactgcagcctcaaatacctgggcacaagcaatccttccacttcagcctcctaagtaactagttctacagatgcacgccatcacacctggttaattttttttaaaaaatgtagagatagggtctctcttttttgcccaggctggtcttgaactcctgtcctcaagtgatcctccaacctcagcctctcaaagtgctggaattacaggcatgagccactgcatctggctcatatattcactttttatctgtttatcctcttcaataaaatgtctcatcatgactgttactcattttctttaaaataatattttatatattttaaatgacataaattatacatattaatggggtacatagtgcctttcagtagatacaatgtatagtgatcaaatcaggataattaacatacccatcacctcaagcatttatcattgattttggttgaaaactttcaaaattctctcttctagccatttaaaaatatgtaataaattattcttggctacagacaccctacagtgctatagaacactagaatttatttctacttctaggttaaattttgtatcctttaatcaattgcttcctatcccctcttctcactacactttcagcttccagtaaccactattctactctttacttctatgagatcaacttttttcggttctgcatatgagagaaaacatgtattatttgtatttccctccctggcttatttcatttaatgtaatgtcctccaggctcatccatgtggtcaccaatgagaggatttcattctttttaaatggctgaatagtattccattctgtatatataccacatttttttctctatgcatgttgatgaatacttacattgattccataccttggcttctatgaacagtactgcagtaaacatggtggcataatatctccttcatatactgatttcctttactttgggtatatacccagtaatgggatgactggatcatattttatttctatttttagtttttttgaggaatggccatactgttacctataattcctgttctagtttacattcccatgaacagtatataaaagttcccttttcctcatatactcaccaggaattgttaattttggaatttttgacaataggcattctgactggaaaaataagatatctcattgtggttttgacatacatttccctgatgattaatgatgttgaagaggtttttttttttttcatatatttgttgtccatttggatgtcttctttagagaaatgtccattcagattacttgcccattttaaattgaattattattattatttgctttggaattgtttgagttccttctatattctggatatgactaccttgttgaatgaatagtttgcaaacattttctttcattcttctccactctaatgattgttttctttgtagtgaagaaaacttatagtttgatagaattctatttgtctattcttgtttttgttgcctgtgctttgaggtcatatttataaaatattcaggcacggtggctcatacctgtaatctcagcactatgggagactgaggcaggtggatcacttgacgtcaggagatcgagaccagcctggccaatacagtgacatcccgtctttactaaaaaataaaaaataaaaacaattagctaggtgtgatggtacatgcctgtaaacccagctactagggaggctgaggtaggagaatctcttgaaccagggaggttgcagtgagctgagattgtgcctctgcactccagcccgggtgacagagtgagactccatctcaaaaaaaaaaaaaaaaaaaaaatccccagacaaatgacctgaagatttttgaattgattttttataaggtaaaaggtaggtctagtttcattttttctatgtgtggataaccaatttttcagcaccatttattgaagagactgtctttttcctaatgaaggttcttgacacctttttcgaaagtcatttagtagtaactacatgggtttatttctgggttctgtattttattttgttggcctatgtctggtttttttatgacagtgctgtgctgttgtagttactatagctttataatatattttgatacctggtaatgcgatgcctccacctttgttttgtttttgtttgtttgttttttgttcaggatttctaaggctattcagtgtcttttgtagtttcaagaaatttagaaatgtttttcttctatttctgtgaagaatgttattggtagtttgatagcgattgcattgaatctgtagattgttttgggtagtatggttattttaatatgttatttcttcaagtccatgaacatagactatattttcattttttttcgtacccttcaatttctttcatcagtattttacagtttgtcttgtagagacctttcacctcctcaattaaatttattcctaggtaatttttttctagctagtatacattgaattgttttcctgatttctttttcagttaattcctttttggtgtataaaattgatactgatttctgtatgatgattttctattctgcaaatttactgaatttgtttatcagttttaagagttttttggtgtagtgtttaggttttctatatataaaattatgctatctgcaatgagtgacaatttgacttcctcctttttcaattggattacctttatttatttattttgcttaattgctctggctaagactttcaatatgatgattcataagagtagtaaaagttggcatccttgtcttcctccagttcttagaagaaaatctttgtggcctttactatgttgagatatatttcttttacaactaatttgtgaagtttttataatgaaggaatgttgcattttatctatttttcttcatctattgaggtgatcatatggtttttatccttcattctgttgatgttatgtaacatgtttgttgatttgtatatattgaactacctttacatcacttgggtaaatacaacttgatcatggtgtattatctttttgatgtgctcttggatttggtttgctagtgttttgttgaggattgttgcatctatgttcatctgagatattggtctgtagtttttgttgttgttgttgggttctatctggttctggtataagggttatgctggtttcatagaatgagtttagaagtatttccccttcaattctttggaacagtttaagaagaagtggtattcattcttctttaaaagtttggtggaattcaacaattaagtaatctgtccctgggcattcctttcttgggagaccttttgttaatgattaaatgtcattaatcattatgggactgttcaggttttatatcttttctttgttctaactggtaagttgtatgtatccaagaatttatgcattttctaatttgttggtatatagttgttcataatagactctaatgatcctttgcatttctttcatatctgttgggatgttttctttttcatttctgattttatttatctgggtcttacctcttttttcttagtctagctaatggtttgttaattttgtttatgctttcaaaaaccacagcttttcattttgttgatcttttgcattttttagcctcaattttgtttatttctactctgtttgtaattgtttcttttcctccattatcttttggtttgatttgttttttctttcctagtttttgaggtgaatttttatgttacttattttaaatctttctactttttttttcaacttttattttagattcaggaagtacatgtgcaggtttggtacctgggtgtattgtgtggtgctgagttttggagtaagaatggcccagtcacccaggtaatgagcatagtacgcaacagttagtttttcaactcttgcccatctccctccctcccacttccagtagtctccattgtttattgttgccatcattacgttcatcagtatccatcgtttagcacccacttataagtgagaacatggttttatgtttctatgctaatttgcttatgataatggtctccaacttcatccatgctttggatgcagcaaaggacatgatttcatctatttttatggtccacctttgatgagcacctagggtgattctgtgtcttttctgtcatgaatagtactgtgatgtacatgagaatgcatgtgtttttttggtaaaattatttgttttcttttggatatatacccagtaatgggagtgctgggttgaatggtagttctaagttctttgagaaatctccaaactgcttttcacgagggctgaactaattcatattccaactaacagtgtgtaattgtttccttttcaccacagcctcgccagcatcttttttttttttacttttaaataatagcccctctgactgatgtgagatggtatctctttgtgattttcatttgcatttctctgatgattagtgatgtggagcattttttcatatgtttgatggctacttgtatatcttcttttgagaattgtccattcctgtctttgcccattttttgacagtgttatttagtttttgcttgttcaattgcttatgtttcttatagattctggatattagaactttgtcagatgaagtttgtgtctttctacttttttatgtagggatttattactgtaaatttgcctcttaatgctgtttttgctgaattgtgtaggatttggtatgttgtgtttctattttcatttgtttcaaattatttttaacttaaaaatatttcttggccaggtacagtggctcacatctgtaatcccagcaagttgggagcccaaggcgggtggatcacctgaggtcaggagttcaagaccagcctggccaacatggtaaaaccccatctcctgtaatcccagctactcaggaggctgaggcaggagaatcgcttgaatccaggaggtggaggttgcagtgagcagagattgcgccattgcactacagccttggtgacaaaagggaaactctgtctcaaaaaaaaaaaaattcttccatgacccattgctcattcaggagcatgttgtttaatttccatgtatttgtaccgttttgaatattcctttttactgatttctacttttattcagttatgttcaaacaatatacttgatatgattccaatttttaaaatactggagtttttttattatactttaacttttagggtacatgtgcacaacatgcagttttgttacatatgtatacatgtgccttgttggtgtgctacacccattaactcttcatttaacattaggtacatctcctagtgctatccctcccccctccccccaccccgcaataggccccagtgtgtgatgttccccttcctgtgtccatgtgttctcattgttcaattcccacctgtgagtgagaacatgcggtgtttggttttttgtccttgtgatagtttgctgagaatgatggtttccagcttcatccatgtccctgcaaaggacatgaacccatcaattttatggctgcatagtattccataatgtatatgtgccacattttcttaatacagtctatcattgatagacatttgggttggttccaagtctttgctattgtgaatagtgccacaataaacatacgtgtgcatgtgtctttatagcagcatgatttataatcctttgggtatatacccagtaatgggatggctgggtcaaatggtatttccagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatctcactgtggttttgatttgcatttctctgatggccagtgatgatgagcttttattcatgtgtctgttggctgcataaatgtcttcttttgagaagtttctgttcatatccttctctcactttttgatggggttgtttgtttttttcttgtaaatttgtgggagttcattgtagattctggatatcaaccctttgtcagatgagtagactgcgaaaattttctcgcattctgtaggtttcctgttcactctgatggtagtttcttttgctgtgcagaagctctttagtttaattagatcccatttgtcaattttggcttttgttgccattgcttttggtgttttagacatgaagtcattgcccatgcctatgtcctgcatggtattgcctaggttttcttctagggtttttatggttttaggtctaacatttaagtctttaacccatcttgaattaatttttgtataaggtgtaaggaagggatccagtttcagctttctacatatggctagccagttttcccagcaccatttattaaatagggaatcctttccccgttgcttgtttttgtcaggtttgtcaaagatcagatagttgtagacatgtggcattatttctgagggttctgttctgttccattggtctttatctctgttttggtaccagtaccatttttttttttgtttactgtagcctagtagtatagcttgaagtcaggtagcgtgatgcctccagttttgttcttttggcttaggattgacttggcaatgcaggctcttttttgattccatatgaaatttaaagtagtttttttccaattctttgaagaaagtcattgctggcttgatggggatggcattgaatctatgaattaccttgggcagtatggccattttcatgatattgattcttcctagccatgagcatggaatgttcttccatttgtttgtatcctcttttatttcattgagcagtggtttgtagttctccttgaagaggtccttcacatcccttgtaagttggattcctaggtattttattctctctgaagcaattgtgaatgggagttcactcatgatttggctctgttttctgttattggtgtataagaatgcttgtgatttttgcacattgattttgtatcctgagactttgctgaagttgcttatcagcttaaggagattgtgggctgagacaatggggttttctagatatacagtcatatcatctgcaaacagggacaatttgacttcctcttttcctaattgaataccctttatttccttctcctgcctgattgccctggccagaacttccaacactatgttgaataggagtgatgagagagggcatccctgtcttgtgccagttttcaaagggaatgcttccagtttttgcccattcagtatgatattggctgtgggtttgtcatagatagctcttactattttgaggtacatctcatcaataccgaatttattgagaatttttagcatgaggggctgttgaattttgtcaaaggccttttctgcatctattgagataatcatatgttttttgtcattggttctgtttatatgctggattatgtttattgatttgcgtatgttgaaccagccttgcatcccagggatgaagcccacttgatcatggtggataagctttttcatgtgctgctggattcagtttgccagtattttattgaggattttttcattgatgtccatcagggatattggtctaaaattctctttttttgttgtttctcttccaggctttggtgtcaggatgatgctggcctcataaaatgagttagggagtattccctctttttctattgattggaatagtttcagaaggtatggtaccagctcctccttgtacctctggtagaattcggctgtgaatctatctggtcctggactttttttggtgggcaagctattaatgattgcctcaatttcagagcctgttattggtctatttagagattcaacttcttcctggtttagtcttgggagggtgtatgtgtcaaggaatttatccatttcttctagattttctagtttatttgcatagaggtggttatagtattctctgatggtagtttttacttctgtgggatcggtggtgatatcccctttatcattttttattgtgtctattattttgggggtctcacatatggttaatcctggagaatgttccatatattaacaataaatataaatatatttttcagaggttgggttaaaccttctgtaaaggtctgttaggtccatttggtctgtgatgcgttttaaatctgatgtttctttttttaattttttttgtgtagataatctgtccaatgttgatagtggggtgttaccttttcccagtattattgtactgaaatatatatctctctttagatgtaataatatttgtcttatgtatccagttgccctggtgttgcacgtacatatgtttacaattgttttcacctcttgcttgattcctttagtgttgtataatattcttaatatcctttttctttacagtttttgacttaaattcagttttatctgatataagtttagctacacctgcttacttatgatttacatttgcacagaatatcattttcatcccttcactttcagtttatatgtgtctttacaggtgaggtgaattttttataggcagcatgtagttccttctttttttatccatttggccagactatatattttaattggaaaatttaatccatttacattcaaggttattattgataggtgaagatttgctcttgtcatttttaatggttttatggttgttttatattttatctactattttcttccttcttattgcatatccttttggtatcaaggttttttgtagtagtaacttttgattccattctttttctcatttgtgtatcagttctaccactaagttttataattttggttgttttcatgatgaatgttattgtccttttgcttccagatataagacttctttgagcatatcttttaagaccaatttaatactgataaattctctcagtttttgcttatctggtaaagatgttatttatccatttctgtagggtaggtttgctgggtgtagtattcctagccagtagtattttctttcagctctttgaatatatcattccatactcaacttgcctgtaaggtttctcctaagaaatctacttttagtttaaatgaaggattttcatatatgtgatttgatgcttttctcttctgttttttagaatgttctctttgtctttaacttttttttctgtaagttatttgagtacaggtggtatttagtcacatgagtaaattctttaatggtgatttgtgggattttggtgtaccccatcacctgagcagtatacactgcaccatatttgtaatcttctgtccctcaccccattcccactcttctctccaagtctccaaagtccattgcatcattcttatgtctttgcatcctcatagcttagctcccacataacagtgagaacatatgatgtttggttttccatttctgagttacttcacttagaataataatctccaatctcatccagttcactgcaaatgaattaaattcattcttttttctggctgcatagtattccatcttatatacataccacagttatttttttttatccacttgatgactgatggacatttgagttggttccacgattttgcaattgtgaattgtgctgccataaacatgcatgtacaagtatctttttcaaataaggacttcttttcctctgagtagataccaagtaatgggacagctgcatcaaatggtagttctacttttagttcttttctcagtagatacccagtagtgggattgctgaatcaaatgttacttctacttttagttcttttaggaatctccacactgttttccacagcagctgtactagtttaagttcccaccagcagggtagaagcattccctgttcactctatccacaccagcatgtactgttttttatttttggataatagccatttttgcaggagtgaggcggtatcgcattgtggttttgatttgcatttccccaatcattagtgatgtacagcattttaaaatatgtttgctggccatttgtgtatcttcttttgagaattttctattcatgttcttatcccactttttgatggaattgtttgtttgtttttttcttcctgatttgtttgagctcattgtacattgtggatattagttgtttgtcagatgtgtagactgcgaagattttctcccacactgtgggttgtctgtttactctgctgactgttctttttgccatgcaaaagctttttagtttaattaggtcccagctatttatctttgtttttattgcatttgtcttgggttcttggtcatgaaatccttgcctaagccaatgtctagaggagtttcctgaatgttatcttctagaacttttatcgattctggtcttaggtttaagtccttaagccatcttgagttgatttttatataagatgagagatcatgactcagtttcattgtcctacatgtggctagccaattatctcggcaccatttgttgaaaatggtgtcctttccccactttatgttatttgtttgctttgtcgaagttcagttggctgtgtttgggtttatttctgggtatctattctgttccattggtctatgtgcctatttttgtactagtaccttggtgttttggtgactatggtcttatagtatagtttgaaatcaggtagtgtgatgcctccacatttcttcttttttgcttagtcttgctttgcctatgcgggctctttttttggttccatataaattttagaattgtttattctaattctgtgaagaatgatggtggtgttttgatggggattgcattgaatttgtagttgtagattgcctggcagtatggtcattttctttcttttaaatgcaataatgaatagtgtttattgtgtctaaaaatatcagattataattctaataaatgaaactgacaaaaatacaaagtacatgggaaacaaaagtgaaactctagaaaataaaaaacatctggatatattagagctttggaggaaatgagcaattcacatgtcctgaagttttcagattgtgctgaagaatgagattacccattctttttatatataatttattgttttatttccccactgatctatttgctataatcatcactctcaaattgtctccctcagtttatttcactccaggctttttgtctcaatgtcaagctatggacactgccactgaccttcatgggatgatgggtgccctactgagcccctctctgctccgtggtaatggtcccattctgaccatggagaagaagcagtgatcttaaggtttcccagaatataactcagaccaaaggaagaatgtaaacaaggcttgcttcaggcttgtgaaaaaggataatacaccaaatatcttaaaactgctttaagttgtgtctcttcttagggctcccatattgaaagcaaaaatcagagcccttgtgttacacagacagtctttacacagcagtaatcagctgctctccgaccaccaggttctccagttatctccaaactgtaacatgcaggcccaatctctttcggcctacagaaaaatggagatttatttcagatccttgacacaaatgaaaatgttccacagttgtcctggggcagtatggtcattttcacagtattgatgagtatccatgggcatggatgtgtttccatttgtttggtctttcgactcattggttaggtacattcctaagtatttttttttcagctattgtaaaaggggttgagttattgatttagttctccacttggtcgctgtcgttgtatagaaggctactgatttgtgtacattactcttatatccagaaactttgctgaattcttttatcacttctgggaggtttctggaggagtccttagggttttcaaggtaaacaatcatatcgccagcaaacagtgacaatttgacctcctctttatcaatttggatgcactttatttctttctgttgtctgattgctctggataagacttccattactatgttgaaggggaggggtgagagctgacatccttatcttgttccagttctcagagggaatgctttcaacttttccccattcagtattatgttggctgtgggtttgtcatagatggcttttattacataaacgtatgtctcttttttttttttttttttttttttttttttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaacgtatgtctcttgtatgccaattttgctgagagcttcaatcataaagggatgctggattttgtcaatttttttctgcatctattgaaatgatcatgtgatttttgtttttaattctgtttatgtggtgtatcacatttattgacttgcacatattaaagcatcccagcattcctggtttgaaacccacttgatcatggtggattatcttttggatatgttcttggattccgttagcaagtattttgttaaggaatatagcacctgtgttcatcaaggttatcagtctgtagttttctttcttgattatgtcctttcctgattttggtattaggatgatgctagcttcatagaatgaatttgtgaggtcatttggattttctctcttcttttcttgattaattttgccaatggtttatcaattttatcttttcaaagaaacaggtttttgtttcatttatcttttaatttttttttcagtttcattcagttctactctgatcttggttattttctttttcctgcttggtttgggtttgttttactcttgtttctctagttcctggaagtgtgaccttagagtgtcagtttgtgctctttcagtctttttgatgtaggcatttatggctatgaacttttctcttagcaccacctttgctgtatcccagaggttttgataggttatttcattattgtcgttcagttcaaagaattgtttaatgtccatcttgatttcacttttgatccaatgctcattcaggagcaagctgtttaatttccatttatttgcatggttttgacggtcctttttagggttatttccagtttattccaccgtggtctgacagagtgcttaatataatttcaattttcttaaacttattgaggctcattttatggcctatcatatggtctatcttggagaaagttccatgcattgttgaatagaatgtgtattctgcagttgttggttgaaatgttctgtatgtatctgttaaatccatttgttccaagaagtttaaatccattgtttattggttgacattctgtcttgattatctgtctagtgctgtcagtggagtattgaagtcccccactatgattgtgtcactgtctatctcatatgtctattagtaattgttttataaatttgggagctccagtgttagatgtacatatgtttaggattgtgatattatcctgttggacaaggccttttaccattatatggtgtccctctttgtctcttagctgccgtcgctttaacgtttgttttgtctaatataagaatagctaccctctgcatgctttttgtgtccattgcaatgacatgcctttttccacctctttactttaggtttatgtgagttgagtctcctggagtcagcagatagttgattggtgagatcttatctattctgcagtttggtatcatttaagtggaacatttaggccatttacattgagtgttagtattgaaatgtgaggtgctgttgcattcattatgctttcttttcgcctgtatactttggctttttttttctttttaacttttagttgtgttttataggtcctgtgtgatttatgctttaaagatattttgttttaatgtgtttccaggatttgtttcaagatttagagccccttttaacagttattgtagtggtggcttggtaatggggaattctctcagcatttgtttgtctgaaaaagattgtatctttccttcatatatgatacttagtttcaatagatacaaagttcttggctgataattgttttgtttatggaggctgaagacagggccccaattccttgtagcttgtagggtttctgcttataaatctgctgttaatctgataggttttcctttgtaggttacctggtgctgttgtctcacagctcttaagattctttctttcatcttaactttggataacctgatgacaatgtgactaggtgaagatctttttgtgttgaatttcctgggtgttctttatgcttcatctatttggatgtctaggtctctaacaaggccagggaagttttccttgattattataccaaatatgtttttcaagcttttagaattctcttcttcctcaggaacactgattattcttaggtttggtcatctaacataatcccagacttcttggaggttttgttcatactttcttattgttttttatttgtctttgttggattgggttaattcgaagaccttgttttcaagctctgaatttctttcttctgcttgttgaattctattgctgagattttccaggacatttcacatttctaaaagtgtgtccagtgtttcctgaattttttattgttttttctttaagctacctatttccttgaatatttcttccttcacttcttgtatcatattttggatttccttgcattgggcattgcctttctctggtccctccctgattagcttaataactaacctcctgaattcttttttcagattaatcagggacttatttttgctttggatccattgctggttaactagtgtgttttttgggaggtgctaaagagccttcttttgtcatattacccgggttggttttcttcctccgtttcatttgggtaggctctgtcagagggaaggtctagggctgaaagctgttgttcagattattttgtcctacagggtgttcccttgatgtagactctccctccttttcctatggatgtggctgcctatgagccaaactgcagtcattgttttatctcttctgggtctatccacccagtgagtctacctgactctgggctggtactgggagttgtttgcacagagtcctgtgatgtgaactgtctatgggtctctcagctgtggataccagtgccccttctgatggaggtgggagggggttcaatggactccctgagggttcttagcttcagtagtttaatgttctatttttgtgctggttggcctcctgccaggacattgcgctttccaggagtatcagctgtgttattatggggaggaactggaggtgggcaaagttttagaactcccaaaattatatgccctttattatccaccaccagggtgggtagagaagaaccatcaggtggtagtagggctaggtgtgtctgagctcaggttcttcttgggtgggtcttgctgtggctgctgtggtggatgggggtgagattcccaggtcactggaggtgtgcacctaggggcattatggctgcctctgctgagtcatgtgagttgtcagggaagtggggcaaagccagcagtcacacgcctcacccagttcccacacaaactgaagggctggtttcactcccactgtgtcccctgcaacagcacccagaccgttttcaggtgtagagcaatacgggcttgaacacctgccccaggctaagaaagcaaagggcttggttcttctcccacctgtggagtctgcccacccaatttatgccttcccctgagttctggccaagaggcttctcacccagttcaaattgttatgagattcaactagagatctgcttctccctgtgtaattttatcccctgctactctctcattggatccctgtgttgccaggcaggaatgacctgttaggggacccagagagctcccagggcctttctgcttcttcctctacccctgtatttcacttggctctccaaattgactcagctccaggtaaagtcagaaacttctgccagaaatgaaccttcaccttctccagtgtgtgtgtgtttgggagaggagggtctccctttcccacttccacagtttgggcactcacaattttggctgggtctcctgggtcctgcaggagcagtctgcttccttcagtgcgtctgttggtcctcttggggttgctggtttgttgatctggagataaaatttacagtgtgagtcaccgcccactgctctgtgcagagttgcaatctggtcctgcctcctgtctgctgtgaactgtttttcacttttgataatttgattatatgtgcctcagagaggacctttttgggttgaatctatttggagatttctgagcttcttggatctggatgtccatctctctcccaagacttagaaaatgttcatctattattttattaaatagtttttctatattatttttccttttttggaacttttgtaatgcagacatttgctaatttagtggtgtcccatgagttctgtaggcttttatttcttttaatttttccagtctgcccagattattccagaaaacttgtctttaaattcagaaattttgtcttctccttgatctagtttgttgttcaaatcctttaatgtagcttttattttattcattgattatttcagctataagatgttcatttgctttttttgacatctttttttgttcaatttctcattcacatcatgatatttttccaattttgttgaattgttaatgtatattctattgtatctcattgaattccattttttaggaaaaaagtcattattttgaattccctttctggcattctgtgtatttccttttctggggggcctgctactggagaattatttcattcctttggtggtgtcatgttttctttctttttcatatttcttttgtgcctacatttatatacatctagtggagtggtagcctctttcaattttatggattaggttttttatgaaaatatattcctgtagttggatcctgagtgtctattgagtgagacatgttgccattaattctaatagtgtaaacccagtgcagcttcttcaagttttattcatgttagtgatgtttatgagtgccttaggctgcaggaattggcaacagcaatggcatatatttgctgggggtggccccatgaggtttttctccttgctgggggtgaatgcatgcacaggtggtaaactagctcagggactggtttgctggtatcaaggttttttgtgctgtttctcaggccagaaatgtgggtacattgagtgagttgaccaagtcagggaacggcttgctagggtcagggctgccaggctgttatgctggctgggggcacggaccatggctgatcaactggctcaggggctagtcctttttggttgggtccactggaccttttttctggttggaggcattggcctgtagcttctgagttggcttggggtttatctactgggtgctggtccactagtctgtttctctggccaggcgaatattttgcccataatttccaccttaaagattttatattcaaaaacagtcacattctgagttactgagggttagtacttcaacataaagatttgagggtaggcatttctggccataaccattggcatctgtattagtccgttctcacattgctatgaagaaatacccaaaactgggtaatttataaaggaaagaggtgtaactggctcacagttccacattgttggggaagcctcagaaaacttgcaatcataatggaagacaaaggagaagcatgcaccttctttacagggtgtcaggacagagtgagtgcaagcaggggaaatgacagatgcttataaaaccatcagaccttgtgagactcactcactatcatgagaacagcatggcggaaatcgcccccatgattcaattatcttcacctggccccccttgatacatggggattatggggattacaattcaaggtgagatttgggtggggacacagagccaagtcatatcagcatcatttggttgtcttttctcattcattttgagattttttttttgccttttccaacaactttaattctttatactcgatatttgcattctgaatcagatatattatacatatcatctaatttacccatttaaagtatacagtttaattgattttagtaaattcatgaacttgtccctccatcatcacgatcaacattataacatttttgttaccactaaaagagaccctacagttctcagcaagcattcctgaatccctgagtgtccctagctgaaggcaaccattaacttactttccatctctatagatttgcctaatctggacatttcatgcatatggaattatacaatatgtagtcttttgtgactagtttctttcacttagcataatgttttcaaagtttatccatgttgtagatctatcaatacttcattcatttcaatgctgaatggtattctatcgcatgtatataccagattttattttatttttatatccattttttggggggaacaggttgtatttggttatatgggcaagttctttactggtgatttacgagattttgttggatccataacccgagcagtatacactgaaaccaatttgtagtctttcatccttcacccccttcccacccttccccttgagtccccaaagtccattgtatcattcttatgcccttgcatcctcatagcttagctcccacttatgagtaagaacatacaatgtttgttttttttattcctgagttacttgacttagaataatagtctccaatcacatccaggtttctgtaaatgccattgacttattccttgtatggttgagtagtattccatcatatatatatatatgtatgtatgtgtgtgtgtatatatatatatatatatacacacacacatacatacatatatatatatatatttatacatacatacatatgtctcacagtttctttatccactcgttgattgatgggcatttgggctgattccacatttttgcaattgcgaattgtgctacgataaacatgtgtgtgcaagtatcttttttgtataatgacttattttgctctgagtagctacccagtaatggggctgctggatcaaatggtagttctacttttagttatttaaggaatctccacactgttttccagagtggccatactcgtttatgttcccacaagcagtgtagaagtgtttccttttcaccgcatccacaccaacattatttatttatttatttatttaattatggtccttcttgcaagagtaaggtgatattgcattgtgcttttgatttgcatttctgcaatcattagtaatattgagcatttcttcatatgtttctttgccatttgtatatcttctgataattgtctattcatgtccttagcatgctttttgatggcatcatttgttttttttcttgctaatatgtttgaattccttgtagattctggttattagtcctttgtcagatgaatagattgtgaaggattgtgaaaaatttctcccactctgtgggttgttctatttactctgctgactgttccttctgccatgcagaagctctttagtttaattaagtcccacctatttatctttgtttttattgcatttgcttttgggttcttggtcataaaatcctcgcctaagccaatgtctagaagggtttttctaatgttattttctagaatttctatagtttcaggtcttagatttaagtccttgatccatctggaattgatttctgtatgagattttatttatgaactcatcagttgataaacatttggatagtttccgcgtttttactattatggataatgctgctgtgagcattcacatacatgtcgctgtgtgaataaacctgtgtttttaattttcttcaacacataccaagaaatggaattgctaagtcacaaggtaactctgtatttaaccttgtaaaaaattaacacagtgtttcacaaaggggctgcaccattttacattcccagcagtagtgtatgagcgttctaattttctttatacccaacaccttttttttatttttattatagtcattctacacggtatgaagcgatggctaatgatgttgagcatctttttatatgcttattgggcatttaaatatgttccatagataattgtctactcaaagtgttttcctattaaaaaaaaattctaatgacacagtaattgtatatacttatggaatatagtgtgatgtttcattacttgtatacattgtgtgataatcaaatcagagtatttaacatattcatcacctcatacatttgttatctttgcccatttgtattgaattatttgtctttttattgttgaattttcaaagttctttatgtatttagttacaagtttttttatcagatgtatgattttcaaaattttctgcattctgtgggttacctttacactttcttgatggtgcccttttaaacacaaacatctttaattttgattatataaagtttatctgtttacttttcagttgtgctgttggtgtcatatttaagaaactattccttaatgtaaggacacaaatatttacacctatattttcttctaagagtttattgttttattttctatcactgaagtcttttgcatttaggtatttgatccattttgagttaatttttgtgtatggtgtaaggtatagatccaaatttattattttgcaagtaaatatccagttgtcccagcacacatatcaaaagactattctttttaccttcaatagtctttgcacctttgctgaaagtcaactgttcttaagtgtaagagcttacttttggactctgtcaactgtgttccactgatttatatgtcaaatcttaaaccagaatcacaacgttttgattactttaaccttgtagcatgttttgagatcaagaagtgtgagtcctcaaaaattttttcttttttaaagttgtttttgctatgctggctcttttgaattctcacatgaatactatttttaagctttatcaaggtataatggatgcataaaagttgaacatattcaatttcctttttttccttgtctgattttgaaatctgggtaatattagactcatggaaatagttaggaagtgctctgaagttgagattttctatgttcttggtttgacaagtgatattttattgtatcctgaccttttggattattatgatgtgagactctgtattgtatttaattattgctttttatttcagtcatttaccttgataatgtatatcacacaagtcgaagtgaaagcggatgtttagttttctgctgggcctcactgctaccatcctaacaaatgcagagcttgaacttccaccatcttgccctgtctcattgtcaagcagtggtggttgaaattcagtttccttcttggccctgcttacacctctaagcaaaattagatcactgactcatatgtttctgtttgagaacttactgtttctgtttgagagcatgaaattcagctccacattctgctccctctgataggagggaagaggagagtaggagggaggtgaaaggtgaactaccacaaacttgcatggcttctttctgcagcaatgacactcgctaagttggttggagttaaatattagctctctgctacaccctactaacactatgtggggtgggcaggaagtaaaagtattgatgaatgttgcctagccctaccttattgtgtcttgttgttggcagctgggagtggaagttcagcttttccttggtccttgctgatatggatattgggggaggcagagtatcattgaatagagtgtcatgtcatattgcctcattctgccctgttgctgcatggtggaagcagaagacagaaaatcaagattccccttggtcccgctgatacgggggtaaggatggggagagagtgctgactagtactatcccacacaactttgctctgtttcattgctgctgagtggggattgaaattcagcaccaccaacatctggaccctcctgatacaacccctgcaaaagcagagagctaactcacactacctttcagtggttataagtagaattttagctccttgctaagctctgctcataatacattggcaaggaaagtgcaatgctaacaagcactatcttgtaccaccttgttttgtctctttgccacctggtgggtacaggagttcagctccctgctagggcctgctgaaaatggcagggatgagggtgggggagtgggtggaagaaaattttcttctgttatttggctggagaggcaaattatctatctatctatctatctatctatctctctctctctatatatatatatatatatatatatttatatgtatatatttaagttgtctgttctgttatgccgcccttatcccaatcctttggctacaagagcaggattttcctgaggcttattttgtatgtgtctattgtatgatttaggttgcaggcttacaatgccccatctgggatatacgagagcctaaaaggaaactcagggagctctcactgcattgttcctcaagtcctgaagaccctgggcagcttgccttttttcacactttagagtctttttgtttgttggttggttatattatatccaggtttttgttgttgttgttgttgagggagaacagcgagaaatgagatgactactccatcttggccagaaatggaagtcagaaatctgtgttttagcaagccctgcaggtgattctgatgtgtgcctcagtttggaaaccatgggttttgcatagtctcctgacctgtcatttttcacatgatgccaattgcagtttgatttagaaccatggaatatcagtgttgggtgaaactgtgaaagacctcactctgcaaactaaacaggtgttcctgaagacacagcttaaatatatctagtaatagaaatctcacttgctaccaagtgagcctattccatctttggccagttcttttagcaagttctgcttagttatgagctgaaaactgtgtctgtgcagtttatatccattcatccctgctttgaccgtctgtcaggcttgagatcttcagagctctgaagacagagactaaattcccctaagtctcctccaagccaaacttccccagctcaagggaactggtttctgacttcctcctcagctcagtaacctccctgtggatatatttctgtttctctgtacccctcattaattatgggacctaggttgagtctgaaaaaacagagtatcacctttttggttctgggtaaatattctctgaggtgtacttcactgaatactggtcatgtaaaatattctgtaaagaaaaatttctatgttcaaataagtttgggaaacactacctgccttaattccctcttggagagccacaataaacattagtgttttagagaattgagaagtccttcagtaaacaaagcgtttcccaaatgtatttaaatacagagcttttttcacataaactcttattaatgcatgtaaaagactttgagtatttttttaatatacacagtatgtggttttaaaaattatttattctttaaaataaatatgcaccattttactatatttagactactatgaatatttaaacattatttagttatgtttctatttatacagtttaaaacacatttctttcattagccacatttttccactgactcatactaaatttgcaggtaagtaaattccctaacctttgagtatagaggccaatactaagcgcatttcctttctttgctgccatcgttttgttataattgttgtttgtttgtttctgtgtttagaaacaagtgcataaccttacatgtatattccaattaaacttcttcttggttttggcccatcatcccagcatctccattcctttttgtctgcttaatcctattcaaagtcctggttccacaatgaattctgcaaagtgggtgcttaataaatgtggcttaactgactgagctgagataatctgtggaagagtttcatgcccatcacagctgagatgagttcagcaagctcctttattgggtatatcaagtctttgctgataatggccttcaagtatagatctctagctggttagggacagcctctctggagcctggaaggtgtaatgagcaaaccgcttaagacccatgcgaagccaaagattctgcaagaatgaaaccaaaatatagaataatgataacagcaataacattctaagcccttacatttgcatggcattttataactttcaaagcatcttcaccttactctttaatttgatcctaataacaaccagcacaacagacaggataggttacgattggagtgaacactgactggtaccacttcttgaatactcagattagagaagtccactgtggataatttggattaatcccctacctttgtctaggaacccctcaaccatacaacatataggcatagtgtagcagttgctaacatcaaatctgtttcaattaagcatttttattttaccaaatagtgactatttagtactacctttgagactgactgcatctatttgcatcaccccttccagtccatatttgtgatctgagcccttcccctttctctgatcttagattgcaaattcatctttaatgtgaattctagactaactccatatataactcagagttatataggtatattgagtatataaatacctttttgaacttttatttcttcatttctaatgtcactggcattttgagcaggaagagttgacctatccctaggaccatggattttcatgctgggagtctcagggagagagaggggctgacaaggcaagagtctgagcatttccctgacctacttaaaccagagtagcaatgaattttctacctagtttaaaagcaagggttctacttcttgaaaataatgatcaacaaaactcctcaaaatctggactagataattttagaagtcctttttaactttgatcttttacggttttgtgagctagaatccaaggtgggcagtagcagagtagaagtaaaataggcttgctaatagataaataaataaataaacttgtattctaggttcagggggtacacgtgcatgtttgtttcaagggtatactgcatgatgctgaggtttggagcatgaatgaatctggcttaaaatgggctttcttatctatggagcctagatttgtacactgtcgttagaactctggatatgtctgtctagtaacaaagccctctcttctttttctcctatgcctgttgctgtgttgtctacttgtgattcctttttcccttctagaatatcactgtaacctgaaggcacctgctcacacaagttggtaaagctttgggggcattaaggaagaatgatttcagtaataaaaatagtccaaatggcggccttaaagattttggctggggcacatggaatttacatttattccactgggtggggacatttaactacttttcatgtgacatagagtatcactggtggtatttcccctagcatacaacctaaataaattgtagatgacaggagaaaggctggaaggagggaagaataaggttgatgagacctaagcaggctctccttagtaccagtgaggcctgaatcatcagcaaatttaataaaatagagatttttaaaattactttaagttctgaaatacatgtacagaatgtgcaggtttgttacataggcatacatgtgccatagtggtttgctgctggtatcaacccgtcacctaggttttaagccctgaatgcattaggtatttgtcttaatgctctcccttcccttgccccacaacccccaacaggccccggtgtgtgatgtttccctccctgcatccatgtgttctcattagtcaactcccacttataagggagcacatgtggtgtttggctttctgttcctgtgtaattttattgagaatgatagcttccagctacatccaggtccttgcaaaggacatgaactcattcttttttatggctgcatagtattccatagtgtatatgtgccacattttctttatccagtctatcattgatgggcatttgggttggttccaagtctttgctagtgtgaatagtgctgcaataaacatatatgtgcatatgtctttataatagaatgatttataatactttggctatatacccaataatggattactgggtcaaatggtatttctggttctggatccctgagggatcaccacactgtccacaatggttgaactaatttacactcccaccaccagtgtaaaagcgttcctatttctccacagccttgccagctctgttgtttcttgactttttaatgactgccattctaactggagtgacatgttatctcattgtggtgtcaatttgcatgtctctgatgaccagtgattatgagctttttttcatatgtttgttggctgtataaatgtcttcttttgagaagtgtctgttcatatctttcatccactttttgatggggttgtttgtctttttcttgtaaatttgtttaaattccatgtagattctggatattagacttttgtcagatggatagattgtcatttttttttccattttgtaggttacctgttcactctgatgatagtttcttttgctgtgcagctctttagtttgattagatcccatttttcaattttggcttctgttgcaattgcttttggtgttttagtcatgaagtctgcctgtgcctatgtcctgaatgaaattgcctaggttttcttctaaggtttctatggttttgggttttatatttacaagtggcttatggtttggggctttacatttacaagtctttaatacatcttgagtcgatttttgtatcaggtataaggaagtggtccagtttcagttttctgcatatggctagccagttttcccagcaccacttgttaactgtggaatcttttccccattgattgtttttgtcaggtttgttaaagatcagatggttgtagatgtgtggtgttattactggggtctctgttctgtttcatttggtgtatatatctgttttggtatcaataacatgctcttttggttactgtagccttttagtatagtttgaagtcaggtaccatggtgcttccagctttgttctatttgcttaggattgtcttgggtatacgggctcttttttggttccatatgaaatttaaagtagttttttctaattatgtgaagaaagtcaatggtagcttgatggggatagatttgaatctaaaaattactttaggcagtatgactactttcatgaaattgattcttcctatccatgagcatgaaaaacgtttttttccatttgtttgtgtcctctcttattttattgataagtggtttgaggttctccttgaagaggtccttgaagtcccctgtaagttgtgttcctagatattttattctctttgtagcaattgtgaatgggagttaagtcatgatttggctctctgcttgtctatttttggggtataggaatgcttgtaatttttgcacattgattttgtatcctgagactttgctgaagttgcttatcagcttaaggagtttttgagctgagataatggggttttctaaatatacgattatgtcatctgcaaacagagacaatctgactttctctcttcctatttgaataccctttatttctttttcttgcctgattgccctagccgaacttccaatgcaactttgaataggagtggtgagagagggtaaccttgtcttgtgccagttttcaaagggatgtcttcccgcttttccccatttagtatggtataagctatgggtttgccataaatagtccttattattttgagatatgttcaatcaatacctagtttatagagagtttttagcatgaagaggtgttgaattttatcaaaggccttctctgcatctactgagataatcatgtgggttttgtcattggtcttgtttatgtgatggattacgtttattgatttgtatatgttgaaccagccttgcatcccagggatgaagtgtacttaatcgtggtgcataagttttggatgtgctgctggatttggtttgccagcattttattgagattatttgcatcgatgttcatcagggatattggcctgaaattttctttttttgttgtgtctcagccaggttttggtatcaggatgatgctggcctcagaaaatgagttagggcagatgccttctttttctattgtttggaatcatttcagaaggaaagataccaactcctctttgtacctctggtataattcagctgtgaatatgtctagtcctggggttttttttttttttttttttggttggtacgctatcaattactgcctcaatttcagaacttgttagtgctctattcagggctttgacttctttctggtttagtctttggaaggtgtatgtgtccggtaatttatccatttcttctatattttctactttattggtgtagaggtgtttatagtattctctgatggtagtttgcatttcttgggatcagtggtgatattccctcatcattttttattgcatctatttgattgttctctgttttcttatttattagtccatctagtggtccatctattttgttaatcttttaaaaaatccagctcctagattcattgatttttgaagggattttagtgtccctatctccttcagtactgctctgatcttcattatatttttatcttctactagcttttgaatttgtttgctcttccttctctagcacttttaattgtgatgttagggtgtcgatttttgatctttcctggtttctgttgcaggcatttagtgctataaatttccctcttaacactgctttagctgtgtcccagagattctggtacattgtctctttgttctcattgatttcaaagaaattatttatttatgccttaatttcattgtttacccagtagtcattcaggagcaggttgttcaatttacatgtagttgtgtggttttgagtaagtttcttaatcctgcattctaatttcattgcactgtggtctgagagactgtttgttatgatttcggttcttttgcatttgctgagaagtgttttattttcaattatgtggtcaattttagaatacgtgccatgtggcattgagaagaatgtatattctgttgatttggggtggagagttctgtagatgtctattagttccacttactccagaattgagttcaagccctgaatatctttgctgattttctgtctcattaatctgtctaatattgacagtgggatgttaaagtctcccactattattgtgtgggagtttaagtctctttgtaggtctctaagaacttgttttatgaatctgggtgcttctgctttgggtgcatatatatttaggatagttagctcttctcgttgcattgatccctttaccattatgtaatgctctgctttgtcttttttgatctttgttggtttaaagtctgttttaccagggattaggattgtaacacctgcttttttttcttttcatttgctttgtaaatattcctccatccctttattttgagcctatgtgtgtctttgcatgtgagatgggtctcctgaatactgcacaccaatgggtcttgactctctatccaatttgccagtctgtgtctttaattggagcatttaccccatttaaattgaaggtcaatattgttatctgtgaatttgattctgtcatcatcatgctagctggttgttttgcatattagtagatgcagtttctttatagtgtcattggtctttatattttggtgtgtttttgcagttactggtactggtttttcctttccatatttagtgcttccttcaggagctcttgtaaggcaggcctggtggtgacaaaattgctcagcatttgtttgtctggaaagaattttatttccccttctcttatgaagcttagtttggctgcatatgaaattctggattgaaaattcttttcttcaagaatgttgaatattggcccccactctcctctggcttgtagggtttctgcagagaggtctgctgttagtctgatggacttccctttgtaggtaacctgacctttctctctggctgcctttaacatttttttcttcatttcaacctggagaatctgacgattatgtttcttggtgttgctcttctcgaggagtaccttagtagtgttctctatatttcctgaatttgaatgttggcctgtgttgctagattggggaagttctcctacataaaatcctgaagtgtgttttccaacttggttccattcttcttgtcactttcaggtacaccaaacaattttaagtttggtcttttcacacagtcccatatttcttggaagctttgtttgttccttttcattcttttttctttaatcttgtcttcacactttatttcagtaagttgattttcaatttctgatatcctttcttctgcttgatcgtttcagccattgatacttgtgtatgcttcacgaagttctcatgctgtgtttttcagctccatcagttcgtttatgtttctctctaaactctttattctggttagcagttcctgttaccttttgtcaaggttcttagcttctttgcattgggttccaacatactcctttagctcagaagagtttgttattacccaccttctgaagcctgtgtctgtcaattcatcaatctcattctacatccaggttttttttttcctttttttggagaggagttttgatcatttggaggagaggaagcattccggtttttggaattttcagcatttttgcactgttttttttttcctcatcttcatggatttatctacctttggtctttgagggtgatggcctttgcatggggtttttgtttggatgtcctttttgttgatgttgatgttgttgcttactggttgttagttttccttctaacaggcccttcttctgcaggtctgctgcagtttgctggaggaccactccagacccttttcgcctgggtatcacaaatgggagctgcagaacaaaaaagattgcttcctgctacttcctctggaagctttgtcccagaggggcactggcttgatgccagctggagctctctggtatgaggtgtatgaggtgtctgtcgacccctgttgggaagtgcctcacagtcaggaggcatgggtgtcagggacccacttgaggaggccctctttcccttagcagagctggtgtgctctgctgggagaatctctcttgtcagtatcagctgctttcttcagagccggcagacaggaatgattaaatttactgaagctgtgaccacagccgccccttccccgaggttctctatcccagggagattggggttttgtctgtaagcccctgaccagggctgttacctttccttcagagatgccctgcctagttaggaggaatctagagaaacaatctagccacagtcactttgctgcacctagcccagacttcccagcctccttagcactgtcaggggaaaaccacctactaaagcctcagtaatggcggacaacctgagacttttttattgttgttctcttgattctgcctagaaatagaacctcacttagatcttagaagtcagaaggaaatacagtctaatagaaatgggccaacagggcttgaaccaggatacaacaggaaatatattgcttttataatttgctgaagggaagacaacgttaggaatgggtctggctttagggtgtttagtgaatgtaagtttatcctggcttaaaattgttaagggaaaattcctaaatgcctgttactgagatgaggaacatatgtcctctctagcatggtacaaaagatactgggaagctgtaggctcctaacactttcctaaacttctcacaccctaactactatgcctaaaattcatacagtttgtcttatcaccataactccacaaggtccctcttaagggcactgaatataagaggcactatctagaaacattttaagggatatcttggagggaatgagtaaggtctgttagctagccagtaaggagtaggcactggatcttggataacataatggttttaggagaataattttcttcctggggtgcaaaaactttactttccctgcatctgatttgaatgtagatagatgtttgctcctggaagttcagggagacagattttagcttgatataataaataactttcaatgtggggtgtcatattaaagaaggccacaatttcttttatattccttccattgagagatgttgcctatgtcccctttctttggctctggttaggctctgtggctgctttaatcagtagaatatggtgacagtggccctatgccaatttcagggcctaggctctaatagattaacagtttccatttcgtgtccctcgaacactttctggagaccctgggatgtcatgtaagaagtcttagtagtctgagatcaccatgctgaaaataacatatataggcaacctcacttttagtgccagctgatgccagcctttcagcattctctgcaaaagaatcaggaatatgaataaagccatctcggccccttcagaccaaccaatttctcagctgaataccatcaagtgacatcagttagtatcaggtggagcagaaaattcagccagccagatcttacctgaattcctaaccaaccaaaataataaggtataataaagtggttgtgttttaagttacaaaagcattggagaatagtttgatacacaataatacatagccagaacagtcagagatatgcaaagataaactgggctgcttctgatctgcctttggtccttggaggtaatgagattcctgtcactagaaatgtataggcagggcctgaatagctactggagagaaagttttataggagatctcagtaacagaaaaaaaaaaatactatttgaatcattagtttctaaatatagcttccccctcagaatcttctggaatgattgtatagaacacatattcttgtctcctctattagccaagattctccatagatacagaatcaatataattgtttgtttgcttgcttgcctgcttgttttgaggaactggctcatgtgattgtggaggcttggccagtctaaaatctaatgggggatgctggaaggctggagactcaggaaagatttgcagtttaaggccaaagacagtctgctagggaacctggaagaactgatgaaatcccaggactgatgtagcagatgacatctgaaaggaatctgctagaaaattccttcttgctggaaggaggtcagccttttgttctattcaggccttcaactgattgaatgaggcacaccgcattatggacagcaaactgctttactcaaagttcaccaatttaatgtaaagctcatagaaaacactctcccagaaacatccagaataatgtataaccaaatatctgggtactgggacccaatcaaagtcaacacataaaattaaccatcacaacctctccccatcctccaccacagattccaatttagtaggtctggaatgggctttgggaatatttatttttagcaagctccttagctgattctgatcttcagccaggttaggcactcactgtacaaatgtaactataagttattttgtagcccagagtctaggtatgtgtaagaagttggtgctaaagtaatctagttcaacttatttacacaagcccacttaccaggccatttcttggcactggactggtgtagcagaaggttgatccctgctgaaccctgcagaaaatcctccagctgccactactaattcagtccttgtgacttcactttttagagtcaacatttcagatggacatttaggccagctgatcctttctctagcttgttctccagacctaggacccaggctggggcatctgaaatctttaccgtgaaaagaaaaaagtcatttcatacacccctctgtttatacacaagaattcattttagttctcagagaaagacaaagatgtggcctccatccaaagagaaaagtgactttcttctgctaactaaagctatcatggcccatgtaatcagtcttttattctgaactctagctgacttttctttgatgagctttgttatttgagaaattgaacagaataattataataatagtaattacaatggctaacccttgttatgcattcggtatatggtaggcagtcttctgaatgcttaaaaatggcaatagttacaacagtcctacgacacatagtgtgttttcttatcatgctcatttttctctctagggaactgacacacagggaagtgctttttacatagttacagagctggtaaatggcaaaattggaatttgaatttagacacctaggttcacaagcctgcacttgtaattattatgttaagccgtttctggtttcagaagcccactgatcctggaggaagatctccataaagagctagccaggcgtcactgatttccatcagcattcttttctttgaatttttcttttatttttattattttaatttttgtgggtacaaaataggtgtatatatttatggggtacttgagatgttttgatataggcatgcaatgtgaaatagcacatcatggagaatggggtatctaccctctcaagcatttatcctttgagttacaaacaatgcaattacactccaagttatctaaaaatttggaagtaagttattgttgatattagtcaccctgttatgttatcaaacagtaggtcttattcattcttcctatttgtttgtacccattatccatccccacctcctgcacagctccccagtacccttcccagtctctggtaactatcctgctctctatcctcatgagtacaattgccttgatttttagattccacacataaaccagaacatgcaattgtctttctgtgcctggcatatttcacataacataataatctccagttccatccatgttgttataaatgactggatcttattctttgttatggctaaatagtactccattatgtatatgtactacattttctttatccattcatctgctgatagacacttatgatgctttcaaatcttagctattgtaaacagtcctgaaacaaacgtaggagttcagatatctcttcaatatactcatttccattttgaggggcatatacccagtagtaggattgctgaatcatatggtagctttatttttagtttcctgagaaacctcaaagctccatagtcatcgtattaatttacattcccactaacagtgtacaagggttcccttttctccacatcctcaccagcatttattattgcctgctttttggatataagacattttaattggagtgatatgatatttcagtagttttgatttgcatttctctgatgatcaactatgttgagcacgttttcatatgcctgttttacatttgtgtgttttcttttgagaaatttcttttcaaatcttttgcccattttttgagtgtattattagattttttcctatagattggtttgagctcgttatatattatgttaattaatcccttgtcagatgggtagtttagaaataatttctcccattctgtatgctgtatgttgtctcttcgcttctttcctttggtgtgcagaagcgttttaacttaatgtgatcccatttgttcatttttgctttggttgccttgattgtgggtattgctgaagaaatttttgcacagtctaatttcctgcagagtttcccaaatattttcttgtagtagttttatagtttgaagacttagacttaggtctttaatccattttcatttcagttttgtatatggtgagagataggggactagtttcattgttctgcatatttatatccagtttccccagcaacatttattgaggatactgtatcttccccagtgtatgtttttgaaacctttgttgaaaatgagttcatggtcagtgtgtagatttgcttctgagactttgattctgttccagtggactacgtgtctgttttcgtgccagtactatgctgtttttttactagagctctgtagtataatttgacatcaagtaatgtgattcttccagttttgttattttttattatactttttatttttatttttttcagacgaagtctcactctgtcacccaaactggaatgcagtggtgctatctctgctcactgcaacctctccctcccgggttcaagtaattcttctgcctcagcttcctgagtagctgggactacaggtgcatggcaccatgcctggctaattttggtatttttagtagagacagggtttcaccatgttgcccaggctgatcttgaactcctgacctcaaatgatccacctgcctcctcggcctctcaaggtgttgggattacaggcatgaggcactgcacccagccccagttttttttttttttctttaggatatctttgcctgttctgggccttttgggctttcatatacgttttaggattttatttccatttctatgaagaatgtcattggtatgttgatagggattgtattgaatctgtagatttctttgaggaatatggacactctaacaatattatttcaatccaagaacaatggaatatatttccattttttgtgtcctcttcaattgcttttatcagtgttttatactttttactatagagttctttcacttctttggttaagttaattgttggtatttaattttatgtgtgcttgttgtaaatgggattaatttttaaattactttttcacattgttcactgttggcatatggaaatgctactgatttttgtatgctgcttttgcatcctgcaaccttactgtatttgtttctcagttctacagttttcttgtggagtctttttttccatatctaagaacacatcatctgcaaacaaggataattttaattcttcctttccaatttggatgctctttattcctttcttttgtcagattgttctggctaggtcttccagtactatattaaataacagtggtgaaagtgggcatccttgtcatgttacagatcttggaggaaaggctttcagtttttccccattcaatatgatactagctgtgagtctttcatataggcttatattgtgttgaggtatattccttctattcccaattctttgaaggtttttatcatgaagggatgttgaattttatcaaatactttttcagcatcaattgaaattaccatatggtttttattcttcattttgttgacaggatgtatcacattgactaatttgcatagattgaaccatccttacatcccagggataaatcccacttggtcatgatgaatgttcttttaaaagtattgttggaaatagtttgctagtatttttttgagaatttttgcatcactattcatcagagatattggcctgtagttttcttttctttctttctttctttcttttttttttttttgaagtgttttcatctggttttcatgtgacagtaatactggcctcatagaatgagtttggaatcatcccctcctcctctatcatttggaatagttttagtagaattggtattctttaaatgtttggtagaattctgcaatgaggccatcaaatcccaggtgtttctttactgggagtccttttattatggctttgatcttgttacttgttactgatcttttcaggttttgaatgtatcctggttcattcttggtaggatgtacgtgtctagaactttgtccatttcttctagggttttcaatttattggcatatagttgctcatagtagccattaatggtatttttaatttatgcagtatcagttgtgatgtctcttttttttcatttctcattttaggtattaggatcttctctctttttttcttaatttgttaaaaggtttttcaattttgtttaacttttcaaaaaacaacttttcaaattaatcttttgtattgtctttttcatttcaatttcatttacttctgctctgatatttattatttcatttcttctactaactttggctttcatttcctcttgcttttctagttctttaagatacatagtaagattgtttatttgaagtttttcctctttattgatgtaggcactggtaactgtaaactttcttcttagtattgcttttgctgtaccctataaatttttgtatgttgtgtttacattgtcatttgtttaagtaaatttttcaattttctttttgatttcttgattatatccctggtcattcaggagcatattgtttcatttttacatacttttgtagtttccaaaattttcttgttattaatttctaattttattccattgtgggcagagaagatgcttaatattattttattttgtaaaaaatgtttaagactttttgtgacctaacatatggtgtgtccctgagaatgatccatgtgttgaggaaaagattgtgtatttttcagctcttggataaaatgttctgtaaaatgtattagatccttttggtctatagtgcagattacatatgaagtttttttgtttattttctctctagaagatctgtccaatgctgaaattggggtcttaaagcctccatttattttggtactgggacctatgtctctctttagttctaataatattttctttttatatcagggtgctccagtgttgtgtgcatatatacttaaagttgttaaatccttttgctgacttgaaccctttatcattacatagtgatctcctttgtctcttcttacagtttttctttcaaatctattttgtcagatataaatatagctactccaactctttttgggtttccattggcatagagtatctttttccatgcctttattttcagtctgtgtgtgtctttataggtgaagtttgtttcttgtggggtcttgatttttcacctgttcagccagttcatcaatgggtcttgtcttttcacgtgttaagccagtctatgtcttttgattagagagtttagtccatttacattgaatgttataatttatatgtaagaactcactcctgtcattttgttatttgttttcctctagttctatccctccttccctccctctctccctccctccctcccttccttccctccctccttccttttcttcctttctttctcttcctatagtgaaggtgattttctctggtgatgtgatttattttcttgctttttattttttgtgtatcaattgtatattttttggtttgaagttaccacgatgctcacaaatactatcttataacctgttattttaacctgataacaacttaacactatttacataaacaaacaaaggagcaaaaagaaaattgataaaaactcaccttaacttcttaccatcactttttaacttttcattgtttgtataatattgatatcttattgtactatctatatcttgaaaagctgttgtagttattatttttgattggttcatcatttaatctttctgcttagaataagactagtttatacaccacaattacagtgttacaataagtgtatgttttcctgtgcacttgctattgtcagtaagtttggtaccttcaggtgattatttattgctcattagtatcttttcctttctgaatgaagtactccgtttagcatttcttgtaggacaggtctggtattaacacaatccttcaacttgggtttgtctgagaaagtctttttttttctcctttatgtttagaggatatttccacttgatatactatgttagggtaaatgtttacttttctttcctttggcacttcaaatgtcatggcactgtctcctgacctatagggtttccactgaaaagtctgctgccagatgtatttcagctccattgtatgctatttgtttcttttctcttgttgattttaggatcctttctttatctttaacctttgggagtttgattattaaatgccttgaggtagtcctctttgggttaaatttgcttggtattctacaaccttcttctacttggatattgatatctttctctaggtttgggaagttccctgttattatccctttgaataaactttctaccttatctcttttcctactttctctttaaggccaataactcttagatttgcccttttgaagatattttatagatcctgtaagcatgcttcatctttttattcttttctcttttgtgtcctctgtgtattttcaaatagtctgtcttcaagctgactaaatctttcttcttcttgatcaattctgctattaaagggctctgattctttcttcggtatgccagttgctttgttcaggtccaaaatttctgcttgatcatttttaattggtttaatatatttgttaaatttatcttatagaattctgaattagttctctgtgttatattgaatttctttgagtttcctcaacacagctattttgaattctctgtgtgaagagtcccatatctttatttctcgaggattggtccctggtgccttacttagttcaatttgtaagttcatgttttcctgcatagtgttgatgctagtagatgtccttcagtgtttgggcattaaacagttaggtatttattatagtcttcactctctggggtttttgtagccatatttcttgggaaagtttttcaggtatttgaaagaactttgatattgttatctaaatggtatatgctttacagggtaccccaagcccaataatactgtgattcttgcagacttgtagaagtactgccttgatggtcttggacaagatctgggataattctctggattaccaggcagaggcggttgttctcttcccttactttctcccaaacatagagtctgtctgtgttctgagccacctaaaactgggatggagtgaaacagatagccctgtggccaccacatctatgactgcactgggtcagacctgaagccagcacagcactgggtcttgtccaagtcctgctgttaccattccctggctactgcctatgttcactcagttcccaggttctctacccccactatggctgtgctcgtgcctaaggtgcaaaacaaagccccctttacattttcctctctttttctctaacagaaggagtttcaccccatagccacaacagctagtaatgttctgagtttcacctgaagccagcaagtctcagaggctcacccaagaccctggatgtaggacctgggtatcggttctgattaagaccgaagagttcttcagttagcaggtgatgaatgctgtcatgactgggcccttttcttcaaggcagcaagtttccttatggcccaaggtgtgtctcaaaatgttgtcatggagctagatcctggaacagggacctcatgactctggccagtgccctatcctgctgtggctgagctggtatccagtatcctagatgcaagacaaagtcctctgcacatttccctttcctctcctcaagcagaatgaaggagtctcttttggaactgagctgtgaagcctagggttgaggatgggtgatgccagcactcccttggctgccccagctagtgtctcagtatgtcgcatgtcctcttagtccacagtctcttggcctagttcagcactgtctcctcccacattctggacattctatacttattaacacagcttaaggtggtgttaatatttggggcaccccattattctctgtactcacaaggtcttgcaaacatctaacccttcctttaagcattttttcactttaggcactgagcttcatcttatgaaaatatgctgtggtaagatgaataaagacccccaagatgttcacatcctgattccctggacctgtgaacatgttaccttatgtggcaaaaagcactttataaatgtgattaatttaaggatcttaaaatgggaagattttcctggaatgtccgaatagcctcagtgtaatcacaatggtccttataagagggagataagaatgtcagagtgggagagagatttgaacattccatgctgctggctttgaagatgaaggaaaggggccatgagccaagaaatgtagatgacctcctgaagctgcaaaataaaaaaaaaaattattcacccctagaacctccagaaaataactgagccctaccaacaccttgattttagtccagtgagatctctgttggacttctgccctctagaactataaggtaatctattgttattgcttgttttattatttactaagttaatgattatttgctacagcaggaagacacaaataataaaaatcaacagttttgtagaaactttaaaatgacaaagcattctagaatggaagactagagcatctagtttaaccagtgaggacacaaagattcagagagggaaacgtacttatccagagtcacatagcaagttactggtaagactgggactggaatctaggtttcttacgttttggggtagggtgattttccccacctgttagctacctctcatagaataagacataactttcagagaatgaactgtggtaaagagaagggaaagaagtagtctgaggtgccagagtaagtcagtgtcagagccaaacctctgatccaagtctccagattcttgtgtttctccattttaccacatagtctgttgcctgtctttggttcaagcatatgtctaatttcctttcattatttgcagccatttttttttttctcctctagcttcatttacctatgtagttctgaaatagtgacaggagttgagaaggagtgagggtaaaaatccctcatctggttaatgtgccagcacagcttttcatggtggcagagcacttgacacttggaaacatttcactttgcagccaacctttgtaaaagcctattttgtgttggttttgtttaataggaaattaaaaaaaaaaacaaattccaaagttttccttagcacattttgtctgtagggaattaatgcaaattattgtgctctttgctcttgttctaagctactagcttttttgaaactcggggatgggaacctgagatgggatgatgagcatgtttaaatagtgcagagattgtgaaagactacaggactagcaagctttctttggaggattctgtcacagacccaggagtcagatagacctaagttcaaatcctaatttcatgactcattaggtgtgtcaattttagcaagtctcttcactcatttgtaaagtagggatagcaatggcattgactttttataattgttaaaatgattaaataagatgttgaacataaaaaacgtagtagaatatttgacacagaggaagctctcaataaatggtacctactgttttgctcttgttgttttcacattgcaaaaatgacaaagtctgagatatgcagagcaagctgacatggcaaagccacccagttcttttccagatccagcaagttctcagtgctctaggcttggtaaggctctgggctcagtagatattcattcccaagggcagcccagagccagaagttaaagtaggtaggtagaactcaggaatcataggatctaatctgatattttccctgacttcctcagtgaccatgaccaaaagactgccttcccaaggcttcaatagcctcatctacaaaagaggaggaggacagattagattattaattcattcactcatttattcactctagcacatctaaccactgatacttatatcctggcttaaaacatataggcaatgaaaaacactttgtcaggtcagtgaaatggtctaatttatatttcccagatacagcatgcttggaaatgtggaaaatgatctggaaggggagaaaagagggcagagagaccttttcagaagttggtgtgatgttccatgcaagtaatggtgaggacttgaattggggtagaagcacgaccacaaaatagcctgctaacaactgtgtaaacactgaaccacaacagcactggaccatgtggttgattccccaagaggtattttcagatgggttgactttattgtgtctctttttatatactacaatgtcacttttacacatttcaaaaatcatgtcagtggtgtggcacacattggaaggtctggtctcagaagtgtaaaaagcatggagcacttcagcttgcaaccagctgtcatcctggattctcctcagaggaagccaaaagtactacacttcaaacaagctttttgaaaaaaggccaatgtatgcattgtgcttggtatggctacgggagagtagtgagttagacttcgaaaactactgcaagtagtgtctatgctaatagatacctagacccctttgtcaccagcatttagggttgatcgtgatctatttcaatgctatgatgtaataatacattttgaaaattattcttaagatttaaacatttttctgatcattaaagatgtatttgtgttgtggaaaatgtataacaaatgctaatcatacataacaatatttactgaatgctaacaccatgtgaaagacactgtgctatgcacattgcatacattatttaatgtatcctcatagtagtcccgtgagatagatacttttacattctccatttttaggtaagaaaacagactcaaagtgacttgctcaagtttacatagctagtacatggtagagctagaatttgtggcccattctgtccagctctaaagtttgcatctgtttttaacttttttcttaattaaaaagagataaatatgcacatagagaaaaacctactttttatttcaccatccagaggcaaacactactaatattctggcacattttcttcctgcctttcttggatattttttaaaattttatatttgagagataacagactttaaaggaaatgtgaaactcttccctcaccattcggtgaatggaatgatataaggaggtaagtggaattactctagtaggtaaataaataataaatgaataaataaataagaggcttggtgcagtggctcctccctttaatctcagcactttgagaggccaaggtgggttgatttcttgagctcaggagttggaaaccagcctgggaaacatgaaaaaactcctgctctacaaaaaaataaactatccgtgtgtggtggcacatgcctgtggtcccagctactccagaggctgaggtgggaggatcgcataagcccaggaggtcgaggctgcagtgagccatgatgatgcctctgcactccagcctgtgtgacagaataaggccctgtctctctctctctctctctctctctatatatatatatatatatatatatgaaaatagaagtaaaatgtctcaaattgcatcattcacacacaaccactattagtatttgggctcacctactacctttataacaacatgcacttgttaacatatttacaatcagggtcttacttatcttataagcatctccttaaaccataaattttgttttaaattacatcgtaatattctattatgtatgtatactattgtttgacattttttttttgtttgttttttgaaacagggtctcactctgtcacctaggtagaagtgcagtggtgtcatcatggctcactgcagccttgatctcctgggatcaagcaattctcccacttcagcctcccatgtagctgggactacaggcacatgccaccacacccatataattattattattattttttgtatacacagggtcccactgagttgcccaaggctagtctcaaacttgtgcactcaagggatcctcctgcctcagcctcccaaagagctgggattacaagcataatccactgtacccagcctgtaatccactgtatttctttttttcagcatcctaaataatactgtagtggatatctttttgcagtaacttattaaatctatagaactttgcacatattaataattaatgagacattaattgctatgaaagtctcatgcaattaaagatgacaaaacacagaaagatatttagtgttacagttccaatagttaatcttgtgtgtttgagatgactgtgttaagggggtcataactgcaaaatgtcttcaatatgttgtaactgatatctcaattgctactgataagaacttatttctaaaacgtagaaatttaaagaaactatctttcggcaatctgccaaaaactttttaatatgttcagaacaaattaaatggaagaatatttgcaaggatccaaaacactcccattattcataaaatgatggaaatatgataaacacattttagaaatataaaattaatccctgtggcagagcttaattagtggacaactattcagtaaaatctcagttattctcttctttctgagcacttctctaggctatattcacaagctttccttgcagtttaatgtggccaaaagattgagctctaacagaattaaagtgaaagtgatttctgccctgtctagggattaccccagatatctttcacacatgaccttctacaatctgtgtctttccactgtcttgataaggatgatcacaataacctgggaagctatttgttgaagatagaagagccagatatggaggagtttatttctctaaattgtcacttagaggagatctttataacaacattaattttgaatgttttgcaaataagaaataaacttctatatgtttgagacatatcacatttgggggtttattcattacagttgctatttgttatagttttgccttaaataatgcccttcaatgaaacgcattaaaaatacttataatgccaaaaaaagttaaaaaaaaaagccaccttaagtgattaaaaaatattcaaattatgatacaattttagatgaaaggatcatcaaaaaatataagcctgtctactactagaaccaaagatggtgagaaactaggaggagagttataaaaaagagttgagatttctatgggaaactttcacttttacaactggagaaaatcacttgaaatatagttaaattatatattaaggactactaaaagggaataagaaggaaggaaggaagaaattgaggaagttggggggcatgacagagaagcacaaagaaattggaatggagacacaagcaatgaatgaaacgtctattctaatgactatgcccctttagtactgctttgaccataagcaggcatcatctaagaagagtttacttggtcacaactttcttttttgaaaaagcagccagaagtcttcatactttgctcccacaagatcctggtgtcacagccacagctaattaaatccagaattggtgtcacctaaagcaaaggcagtcattcatatactattcatgggcaatgacataacctgacaggagaatttcatctaattcaggtattttaaacctggtttggagctgccacaccatgagatcccattcctggcatgtctaactccaaggcatatggaaagtcagttagacaattttatcaagatcagtagaagtagaaacaaagagtcaccatgggacaaaatacaagactggtaaaaatgtagtggttcctattctacttctccatatatccttaaaataacttttcattacctgaaataaggcaagtttgtatttatgccttactaaccaaaacaaatactaaaacatacatcagacctttaaaaaagcaacaagatctttacagagaaagctgagatttttaacttgaactctaattaagcagtggaaagaaaatgatttccatgaaacacttccctgaaaatgtaatggatgttagtgagaaaaaataagagaggacagaagcaaatggaaacacattccatgcttattgataggaacaatcaatatcatgaaaatggccatactgctcaaagtaatttatagattcaatgtgatccccatcaagctacaattgactttcttcacagaattaggaaaaaaaaacactttaaatttcatacagaaccaaaaaaagagcccatataaccaagacaatcctaaggaaaaataacaaagctggaggcatcacactacctgacttcaaactatactacaaggctatagtaaccaaagcagcatggtactggaaccaaaacagatatatagaccaatggaacagaacgagggctcagaaataacaccacacttctacaaccatctgatctttgacaaacctgacaagaaagggcaatggggaaaggattccctatttaataaatggtgttgggaaaactgtctagctatatgcagaaaactgaaactggaccccttccttacaccttatacaaaaattaactcaaggtggattaaagacttaaagtaagacctaaaatcataaaaaccctagaagaaaacctaggcaataccattcaggacataggcatggaaaagacttcatgactaaaacacaaaaagtgatggcgataaaagccagaattgacaaatgggatctattaaactaaagagcttctgcacagcaaaagaaactatcatcagagtgaacaggcaatctacagaatgggagaaaatgtttgcaatctatccatctgacaaagggctaatattcagaatctacaaggaacttaaacaaatttacaagaaaaaaacaaacaacctcatcaaaaatgggcagatgatatgaacagacacttctcaaaagaagacatttatgcagccaacaaacacatgaaaaaaagctcatcatcactggtcattagagaaatgcaaatcaaaaccacaatgagatgccatctcacgccagttagaatggtgatcattaaaaagtcaggaaacaacagatgctggagaggatgtggagaaataggactgcttttacactgttggtgggagtgtaaattagttcaactattgtggaagatggtgtggctattcctcaaggatctagaaccagaaataccattttactcagcaatctcattactgggtatatacccaaaggattataaatcattctactataaagacacatgcacacatatgtttattgtggcactgttaacaatagcaaagacttggaaccaacccaaatgcctatcagtgatagactggatagagaaaatgtagcagatatacaccatgggatactatgcagccatacaaaaggatgagttcatatcctttgcagggacatggatgaagctggaaaccatcattctcagcaaactaacacaagatcagaaaaccaaacaccccatgttctcactcataaatgggagttgaacaatgagaacaatcaaataacctgatttaaaaataggcaaagggacttaccttctgagcacagttagcagcacttcagtctcatgaaaaatgggcaaaggatctgaacagacatttctttgaagaatacataaaaagggccaatatttatatgaaaagtgctcaacactaatcaactggaaaatgcaagttaaaaccactatgtgatattacctcacacctgttaggatggctattatcaaaaagacaagagacaacaaatgttggcaagggtgtggagaaaagggaaccctagtacactgttagtgggaatgtagatttttgcagtcattatggaaaacagcatggaggtttctaaagaaattaaacatagaactaccataaaaaatgttgtatatgttttatgtatggcacatgcaatatgctaacaactccccaaagttatccccaggcagcaccttttacccaaatgttagacttgtatatacaaccacctacttcacaacttgactcatatgtaaaagcatctccaatttactccaaatacaaactgcaagccaaactccaaattgtctccactcaaaattgtttctatcccaaccttccccttctctatcaatggaatcatttctctagctccttaggggaaatatcttgaagtcatgactcttctcacaccaccacataccatctaccagcaagtcctatttgctttacttctgaaatgtatccagaatatgactacttctcaccacctccagtgctaccacactggttcaaaccaccattgtcttatacttgaattttaggctctttattaatttccttaattctacacttgtccttttttggttttgttcttcaaacagcacccagaagacaaaaaaattacttagaactatttaccttgcttctcccagctaagtacaattataaattctggaaataatgcaagaggcagccaaagcagaattctgaaaagtgcaaagaggaaggcaaacaggctaagcaccctaggactactggggaacagcatagaagcatgacgtcttattaccctcccctgatctaatagaaaaaggtaacccaagccaggtgtttcccaccccaatctagcaagagaaggcaacacaggtagtctcatttttttcccatatcaaacaggaactctaacaaagacacataaggagactgtcatcaccagtaaggggggttaataaaaaataccactgacaataattggccaggtgggagagcttttccgccttagcaaggttgaactttcctttctccatcaagagataccacgcaaatggaggacactgaccaaacacctcaaaacaagtagttcagccttggaagtgctcttcctccctataggccagaaacttcctgggcatcttctgcctgtctggtagcaccaacaggaatcactgagagtttctacagcaccaaaatcaagcagaacaaaataaaaacacagagttcccccaaattgaattgtcattggaagcaaggcacacaaaagtaggccaggacctgtgagctaaacctaagcagagtgactgcctggtaaaataaaagatttatggctgggcatggtgcctcacgcctgtagtcccggcactttgggaggccgaggcgggcggatcacgaggtcaggagatcaagaccatcctggctaacacggtgaaaacccgtctctactaaaaatacaaaaagttagccagctgtggtggcgagctcctgtagtcccagctactcaggaggctgatgcaggagaattgcattaaccctggaggcggagcttgcagtaagccaagatcgcatcactgcactccagtctgggcgacaaagcaagactccgtctcaaaataaataaataaataaataaataaataagtaaataaataaataaaagattcatatagaacccagaggttttgcgcgtgtaatcccagctactcagaaggctgaggcaggagaattgcttgaatctgggaggtggaggttccagtgagccgagattgcaccattgcactccagcctggcgacagagcaagactccatctcaaacaaacaaaaacaaaaactaaaacaaaagaaagcaaaaccaaaaaacccagatgtttctaacatagtagacaaaacatacaggatacaattgaaaaccacgcttcataccaaggactagcaaaactacaatttaagttagaaaagaatcaatggacaacagtaacagatgaatcagatgttggaattattcaacaaatattttatattagctctcataaaaaatgctccgatgatcaactacaaaatttcttgaaatgcgtaaaacattctgtaggatttctgcttactctgttgataaggaacttaaacaaatttacaaacaaccccataaaaaagtgggcaaagaacgtgaacatttttcaaaagaagacatccatgtggccaacaatcgtatgtaaaaaaagctcaacatcacttatcagtagagaaatgcaagtcaaaaccacaataagatatcatcttataccaatcagaatggccattattaaaaagtcaaaaataacagatgctgatgaggttctggagaaaaaggaactctgataaactgttagtgggagtgtaaattagttcaaccattgtgggagactgtgtggcagtttttcaaagacctaaagatagaaataccattttacccagcaatctcattactgggtatatccaaaagaatatatatcattctattataaaaacacatgcatgcatatgttcgttgcggcactattgacaatagcaaacacatggaatcaacctaaatgcctatcaatgatagactggataaaatatatggtaaatctacaccatggaatagcatgcagccataaaaaaaaatgagattaggtcctttgcagagacacggatgaagctggagaccattatccttagcaaactaaaacagaaaccgaaaaccaaatactgcatgttctttcctataagtgagagttaatgatgagaacacatggacatatagaggggaacaaccacacactggggcctattagagagtggagggtgggaggagggagaagatcaaaagaaatatctaattggtactaggattaatacccaggtgatgaaataatctgtacaacaaacccccttgacacaagtttacctatatagcaaacatgcacatgtacccctgaacttaaaataaaagttaaaaaatagaaatgcatgaaataatagaaggtctcagcaaaaaatagaagttacaaaaatgaatgaaatgaaaattgtaagaaaaaagtaaaataacaaatgcccaatggatgaacttatagtaaaatgaagataacaagagaatagaatcagtgaactttggggtagatcaatagaacgtaccaaatctgatcaacagagagaaaaaaaagagtgaaaaatattgaatagagagtaaggaaactgtgggacaataacaaaaggtccaacatttgtattataatctaagaaagagtggaaaaagagagtgggactgaaaaagtatttaaataaataatggctaaatgttggtgaaaaggccatcagatttcagaagctcagccaaccccaaacaaatgtacaccaaagcacactataattaaatttcttaaaataaagggaaaaaactattaatggtaatgagagaagcaacacctgacatacagagaaacgccaattagaatgaaaagacttccccttagaaatcatggaaaccaaaaggatgtgacacaacaaattctgataagaaagaaaccttctatagcaaattctgtaactgacaaagctatccttcaggaataaaggggaagtaaagacattttcagacaagagaaaactaagaaagtttattgttagtagacttacccttaaaaaaatggctgaaggaagttctccaaacagaaaggaagttttaaccataaatacagctacagaccatagactacatttctccttataaattttataaatcacatttgatgattgcaacaaaaattgtaacatcacctggttctcaaggcttcacacaaccttggaccgctgccgcatttcctctctggcctcatttcctactgtcacttactttgctccagacacactggcccctgctgttccttgaatacatcaggcataatcttgccgtcaggcttcggtattcacaggtaaatttttttttcttttctttttttctggttggaatgttcttccttcaagcatccatgtggtctttgctcaaaagtcacctactcagtaaggctttccctgatagttttctttaaaattgacccccgaaccccaggatttcttatccccattttttgttttattaattcacttgcaagaatgttggctccacgaacacaaatattattttctgttttcgtttttttataatttacgcttcttttttattatactttaagttttagggtacatgtgcacaacgtgcaggtttgttacatatgtatacatgtgccatgttggtgtgctgcacccattaactagtcatttacattaggtatatctcctaatgctatccctccctgctccccgcaacccacaacaggccccagtgtgtgatgttcccttcctgtgtccatttgttctcattgttcaattcccacctatgaatgagaacatgcagtgtttggtttttgtccttgtgacagtttgctgaggatgatggtttccagcttcatccatgtccctatgaagaacatgaactcacaatgttttatggctgcatagtattccatggtgtatatgtgccaaactttcttaatccaatctgtcattgttggacatttgggttggtttcaagtctttgctattgtggatagtgccccaataaacacacatgtgcttgtgtctttataccagaatgatttataatcctttgggtatataaccagtaatgggatggctgggtcaaatggtaattctagttctagatccctgagaaatcgccacactgacttccacaatggttgaactagtttacagtcccaccaacagtgtaaaagtattcctatttctccacatcctctccagcacctgttgtttcctgactttttaatgatcgccattttaactggtgtgagatggtatctcattgtggttttgatttgcatttctctgatggccagtgatgatgagcattttttcgtgtgtctgttggctgaataaatgtcttctttggagaagtgtctgtttatatccttcacccacttgttgatggggttgtttgtttatttatcgtaaatttgtttgagttctttgtagattctggctattaaccctttgtcagatgagtagattgcaaaaattttcccccattttataggttgcctgatcaatctgatggtagtcgcttttgctgtgcagaagctcctgagtttagatcccattcatcaattttggcttttgttgccattgcttttggtgttttagacatgaagtccttgcacatgcctatgtcctgaatggtattgcctaggttttcttctagggtttttatggttttagttctaacatttaagtctttaatccatcttgaattaatttttgtatcaggtgtaaggaagggatccagtttcagctttctacatatggctagccacttttcccagcaccatttattaaatagggaatcctttccccattgtttgtttttgtcaggtttgtcaaagatcagatagttgtagatatgtagcattatttctgagggttctgttctgttccattgatctatatctctgttttggtaacagtaccatgctcttttggttactgtagccttgtagtatagtttaaagtcaagtagtgtgatgcctccagctttgttcttttggcttaggattgacttggcaatgtgggctcttttttggttccatatgaactttaaagtagttttttccaattctgtgaagaaagtcatcagtagcttgatggggatggcattgaatctataaattaccttggacagtatggccattttcatgatattgattcttcctatccatgagcatggaatgttcttccatttgtttgtatcttcttttatttccttgagcagtggtttgtagttctccttgaagaggtccttcgcatcccgtgtaagttggattcctaggtattttattctctgtgaagcaattgtgaatgggagttcactcatgatttggctctctgtttgtctgttattggtgtataagaatgcttgtgatttttgcacattgattttgtatcctgagactttgctgaagttgcctatcagtttaaggagattttgggctgagaccatgggattttgtagatatataatcatgtcatctgcaaacagggacaatttgacttcctcttttcctaattgaataccctttatttccttctcctgcctgattgccctgaccagaacttccaatactatgttgaataggagtagtgagagagggcatccctgtcttgtgccggttttcaaagggaatgcttccagtttttgcccattcagtatgatattggctgtgggtttgtcttagagagctcttattattttgagatacgtcccgtcccatcaatacctaatttattgagaggttttagcatgaagagttgttgaattttgtcaaaggccttttctgcatctattgagataaacatatgttttttgtccttggttctgtttatatgctggattacgtttattgatttgcgtatgttgaaccagccttgcatcccagggatgaagctctcttgatcatggtggataggctttttgatgtgctgctggattccatttgccagtattttagtgaggatttttgtatcaatgttcatcaaggatattggtctaaaattccctttttttgttgtctctgccaggctttggtgtcaggatgatgctggcctcataaaatgagttagggaagataccctctttttctattgattggaataatttcagaaggaatggcaccagctccttcttttacctctggtagaattcggctttgaatccgtctggtcttggcctttttttggttggtaagctattaattattgcctcaatttcagatcctgttattggtctattcagagattcaacttcttcctggtttagtcttggaagggtgtatgtgtcaaggaacttatccatttcttctaaattttctagtttatttgtgtaaaggtgtttatagtattctctgacggtcgtttgtatttctgtgggattggtggtgatatcccctttgtcttttttactgcgtctatttgattcttctctcttttcttctttattagtcttgctagcagtctatcaattttgttgatcttttgaaaaaaacagctcctggatttattgattttttgaagggttttttatgtctctatctccttcagttctgctctgatcttagttatttcttgccttctgctatcttttgaatgtgtttgctcttgcttctctagttctttattgtgatgttagggtgtcaattttagatctttcctgctttctcttgtgggcatttagtgctatcaatttccctctacacactgctttatatgagtcccagagattctggtatgttgtgtctttgttctctttggtttcaaagaatatctttatttctgccttcgtttcgttatgtacccagtagtcattcaggagcagcttgttcagtttccatgtagttgagcagttttgagtgagtttcttaatcctgagttctagtttgattgcactgtggtctgagagacagttggttataatttcttttcttttatatttgctgaggagtgctttacttccatctatgtggtcaattttggagtaggtgtggtgtggtgctgaaaagaatgtatattctgttgatttggggtggagagttctgtagatgtctatgaggtctacttggtgcagagctgagttcaattcctggatatccttgttaactttctgtctggttgatctgtctaatgttgacagtagggtgttaaagtctcccattattttgtgtgggagtctaagtctccttgtaggtcactcaggacttgctttatgaatctgggtgctcctgtattgggtgcatatatacttaggatagttagctcttcttgttgaattgatccctttaccattatgtaatggtcttctttgtctcttttgatctttgttggtttaaagtctgctttatctgagactaggattgcaacccctgcctttttttgttttccatttgcttggtagttcttccttcatccttttattttgagcctatgtgtgtctctgcacgtgagatgggtttcctgaatacaacacactgctgggtcttgactctttatccaatttgccagtctgtgtcttttaattggaggatttagcccatttacgtttaaggttaatatttttatgtgtgaatttgatcctgttattatgatgttagctggttattctgttcgttagttgatgcagttccttcctagcctcgaaggtctttacaatttggcatgtttttgcagtggctggtaccggttgttcctttccatgtttagtgcctccttcaggagctcttgtagggcaggcctggtgatgacaaaatctctcagcatttgcttatctgtaaagtattttatttctccttcacttatgaagcttagtttggctggatgtgaaattctggtttgaaaattcctttctttaagaatgttgaatattggcccccactctcttctggcttgtagagtttctgcggagagatcagttgttagtctgatgagcttccctttgtgggtaaccctttctctctggctgcccttaacattttttccttcgtttcaactttagtgaatccaagagttatgtgtcttggagttgctcttctcgaggagtatatttgtggtggtttctgtattttctgaattttaatgtttgcctgccttgctagattggggaagttctcctgtataatatcctgcagagtgttttccaacttcattccattctccccgtcgctttcaggtacaccaatcagatgtagacttggtcttttcacacagtcccatatttcttggaggccttgctcgtttctttttattctttttcctctaaacttatcttctcatttcatttcattaatttcatcttccatcactgaaaccctttcttccagtttattgaattggctactgagccttgtgcattcatcacgtagttctcatgccatggttttcagcttcatcaggtcctttaaggacttctctgcattggttattctagttagccattcatctaattttttttcacggtttttaacttctttgccatgggtttgaacttcctcctttagctcggagtagtttgatcttctgaagccttcttctctcaactcatcaaagtcattctctgtccagctttgttccattgctgatgaggagctgtgttcctttggagaaggagaggtgctctgatttttagaattttcagcttttctgctctgttttttccccatctttgtggttttatctacctttggtttttgatggtggtgacgtacagatggggttttggtgtggatatcctttctgtttgttagttttccttctaatagtcaggaccctcagctgcaggtctgttggagtttgccaaagttccactccagaccctgtttgcctgggtatcagcagcggaggctgcagaacagtgtatattggtgaacagaaaatgttgctgcctgatttttcctctggaagttttgtctcagaggagtacctggccatgtgaggtgtcagtctgcccctactgggggttgcctcccagttaggctacttgggggtcagggacccacttgaggaggcagtctgtctattctcagatctcaagctgcgtgttgggagaaccactactctcttcaaagctgtcagacagggacatttaagtctgcagaggtttctgctgccttttctttggctctgccctgcccccggaggtggagtctacagaggcaggcaggcctccttgagctgcagtgggctccacccagttcaatctacctggcccctttgtttacctactcaagccttggcaatggcaggaaccactcccccagcctcgctgctgccttgcagtttgatctcagactgctgtgctagcaatgagtgaggctccgtgggcatagggccctccaagctaggcatgggatataatctcctggtgtgctgtttgctaagaccattggaaaagtgcagtgttaaggtgggagtgacccgattttccaggtgccatctgtcacccctttctttgactaggaacaggaattcccttaccccttgggcttcccaggtgaggcgatgccttgccctgctttggctcacgctcagtgcactgcacccactgtccaacaatccccagtgagatgaacccggtacctcagttggaaatgcagaaatcacctgtcttctgcatcgctcacgctgggagccctagactggagctgttcctattcggccatcttggctccaccctattttctgttttctttaatttgtgtccctagtgcctaaaagaatgtttgacatatagtagaggctcatctgcttgaatgaatgaaaacaaaatcaagacttttctctcttggaggctttataaatgacaatgccacatttggaacagaacacatatcactccttttcctaggctgagagaaaagttgtcataatttagagggaataaaggataaacagcatttataaatataaatatttttcaattgatgaacatttcatattctatcctatggattttattgtctcttgtttattgaacacctactatgtgttgacctttatataaaaagctcatttaatattcacaacaaacttatgaagtaggctttgccatttttcattctaacatgctgcagtttttttttaaatgcaccatttgtttcctagtagacttttaggagaagaaaataaaaaaggcaggcaggtaggactcccatagtaaatatacatatggattataggatgcccgagcatttcagaaactttaaaatgttccaacatttgaggcagtatgttattagaccccttacacaaatgaatacatagaagcttagagaggttaaataaattggctttcattcacataaccaagtgaatagcagaattcaaatacagatctacttaattacaaagcctgtgatatatccactacacttccctggtttctaagatgatatccccattcttttagccagggttgttaccaccccataaagggcatctagagatgtctagagatgttgggaggcaggggagtttatgtcctaataacatgggaatacctgtggcgtttagaaaatgggagccaggaagcctacatattcatacaatgcataggaccagttccgtccaacaaagaactgtcccacaaataggtaacatggctgaaaaatcaacattaactgacagctcactctatgccagtgctggggtaagtgatagggatataaagatgaaaaagacttggttcttaatttcaggaaacctattttcgagtgagacaaacaaacaaacagccatctcatacatcacaataagtaatttatcaaaattatggacaaaggaatataggagtcagagaaagaggaagaataagtcagaaaaggtttcatggagggagtagcctctgagttggatcttcaaaagtaagtataagtttttttaactagataaagagggttagtatttcaggactaggtgacagcatatgtgaaggcataaaatgtaaaaggacatgtcaggaaaggtagttatatgtactggctgaaactgcagctctagagcttagctgcattcatagtctgcctttgctacttcctagctatgaatctgacaagctacttaacctccttgtgcttgtttttcctgtataaaatggggataataataatggaattatttcataggactgatggaagagtaaattagttatatatgaaatatttctaatggtatctagcacatagtaatctttcagttaatgttagctgttattttaaaaacaagagattcatttgttctactatttgtactctgtttcagcaagtatctaagacagatgacagataggtaggtagatagatacagagagataaatattggaattgagggaaactgcgaaatgtccatttttactaaagcatcagttgggatgcataaaatggaaaggtggaacaaagttcacatcactgtatttatatcagacataaggagtttagattttatcctatagtaaatggggagccatagatggatcttaggcagaggagtggcatgatcagatttgtgttctgattctactgtggaagatggactgaagaggagagactgaagatagggagaccaataggaagtagctgaagagatccaggatacaagtgataatatctatcctcaggcaagggtagttagagtgttaaggaagggatggatttatgactgaatcacaatacacttggttattgatcaattggatataaatgagattgagaaatgtgaggaaagagtggaagttaagaacccagatatagaagtctcttgactcttgtccaatgctcttacatttctttaagttgtttaattttctctgatgctgcccttagtttgtgctggacctcttccatggcacagaggcctgctcttttagtgacgtatcctgtgtctcctcgttttctccattattttactaaggggctctaagctgggagtacaacttctctctttcctttatgtccagaggtgctcatttatagaagtactcctggcggttggccatcacttacccaggaactcctaaggcccttgggtggcctgggcatgggcacaggaattgaggaaggtgccaagaccccattgctgtctaatggcacagttctctgggatccaattctgtgtctctgtgggaaatctctgcaaatactgtgattccagccaccctgtgggctttgcccaaacagagagtgcttttggctgagccaccactccttccatttctaaactttgtgtatttcaagggaaatctgatctggacctttctgattcatttacacttaaataacccaaggactctgttgtaagagtaaactcagctccaaaaatgtcttataagatttagttataaaactccctaagattttgtgagctagaattttttttacccccccttctctttgaaacaagatgttgtgactttgccaagagtaaatggatttgcaacctcaaaggggtcgtgtttggttcaagagtcagaaatcatgaagttcaaaggcccaaatgcattcttcaagaattggcaaaaaagaacccaagtggatgggataaatgataaatctaggaggaacttggtgagggggtgacaggaagcattcattctactcttttggttccgtgtcccaaagcctcatgacttttgtctcttaactgagaaaatggagtcatgagaaagcacactcctacaagggaccaggaaaatcaggcagagagacaactcccattttgagtaagttcctgactgtttacagaatgcttttcacagtgttttctctcacttagttaatcctccaacagccctgtgggctagcaataatcatccccattttccagaggaagagaatgaggtttagaagagaggaagtgacatatccaatgctacagaactgttttacaacaaagtcaggaattctctttaatgaaattcagactatattaggctagggagaagtaagatgtggaaacttaccttgggctgctgacagccaagaaggtgactataacggagtttctatttatgaaactctccttgatgaaccccagctaagagttgtcccttgcttcattgaaaccccatgagaagtttgatcatgcatctcatagaacatatataacattttccctttgttttatagttatctgtgtatttattttataaccttcattctcatttttcttcatatttcactagactatgagcatctcaaagactgaaatgtgtcctgctcatctttctgcccagtgtctagttcagtgtctagcacaagatagagtaatctgtcagtaaatgttgaaaagataaatgtgcagagggtggatatgtgagcatgtccagacaccaatgtatgtgtatgttgatttgtgtttgtgtgggtgtggagataaatgcattttatagaaatatagattttggtggggatgagtatgtattcatgtgcattaaaaaagtggggtatgggggcttgaggaggtggctggcaagaagccatgagggactgtgccatgaggaacagtgcatcccagcccagatactacacttttcccacaatctttgcaatccacagacaaagagattctcttggttgcctacaccatcagggccctgggtttcaagaacaaaattgggcagctgtttgggcagacaccaagataggtgcaggtttttttccccccagtggtgcctggaataccagcaagacaaaaccatttactcccctggaaagagggttgaagccagggagccaagtggtctagctcagtggatgtcactccctagaagccctgcaagctaagatccactggcttgaaatactcgctgccagcacagcagtcagcagtcgaccagggatgctggagcttggtgggggtaggggcacccgccattactgaggattaagtaggcagttttcccctcacactgtaaacaaagtcgcctggaagtttaaactgggcggagcccatcacagctccacaacaccgctgtagccagactgcctctctagattcctcctccctgggcagaacatctctgaaagaaaggcagcaaccccattcaggggcttgtagataaaacctccatctccctgggacagagtacctgtgaaaaggggtggctgtgggcacagcttcagcagacttaaactaaacattcctgcctgctggctctgaagagagcagtggatttaaaagcaaggcgctcaagctctgctaagggacaagctgcctcctcaagtgggtccctgacccccgtgactcctgactgggagatacctcccagcaggtgtcaacagacaactcataccagaaagctctggctgacatctggtggtgcccctctgggatgaagcttccagaggaaggagcaggcagcaatctttgctgctctgaaggctctgctggtgatacccaggaaaacaggtcctggagtggacctccagcaaactccagcagacctgcagcagaggagcctaactgttaaaagaaaaatgaacaaacaaaaagggatagcatcaatatcaatataaaggatgtccactgaaaaacctcattcaaaagtcgccaacatcaaaaatgaaagttagataaatacacaaagatgagaaaaaccagtgcaaaaacacagaaaatttcaaaaactagaatgcctcttctttgctaaaggatcacaactcctcaccagcaagggaacaaaactgaatgaagaatgagtttgacgaattgacagaagtaggcttcagaaggtgggtaataacaaactcctctgagctaaagaagcatgttctaacctaatgcaaggaagcaaataatcttgctgacggagctggaaaacacagcatgagaacttcgtgaagcatacacaagtatcaatagccaaatcaatcaagtggaaaaaagatatcagagattgaagatcaacttaatgaaataaagcatgaagaaaatattagacaaaaatgaccgaaaaagaaggaacaaagcctccaagaaatatgggactatgtggaaagaccaaccctgtgtttgattggtgtacatgaaactgatggggataatgaaactaaatcagaaaatgctcctcagctttttatccagaagaacttccccaacctaccaagacaggccaacattcaaattcaggatacatagaacaccatgaaggtactccttgagaagagcaaccctaagacacataaacatcagattcaccaaggttgaaatgaaagagaaaatgttaagggcagccagagagaaaggtcaggatatgcaccataaaaagcccatcagtctaacagtggatctctctgcagaaactctacatgccagaagagactgggggccaatatttaacattcttaaagaaaataattttcaacccagaattacatatccagccaaactaagcttcataagcaaaggagaaataaaattctttctacaaaagctcctgaaggaagcactgaatatgaaaaaaaaaaggtcccagtcactggaaaaacataccaaattgtaaagaccattggcactatgaaaaaactacatcaactaacaggcaaaataacctgctagcatcataatgacaggattaaattcacacataacaatattaatcttaaatgtcaacagactaaatgccccaattcaaaggcacagactggcaaattgaataaagagccaagacccattagtgtgctgtattcaggagacccatctcacgtgcaaaggcacacatgggctcaaaataaagggatgaaggaatatttaccaagtaattgaaaagcaaaacaaagcaggggttgcaattctagtctctgataaaacaaactttaaaacaacacagatcaaaatgacaaaaagggcattatataatggtaaatggatcaatgcaacaagaagagctaactatcctaaatatatatatacatgcatccaatagagaagcactcagattcataaagcaagttcttagaaaactgcaagagactagacttccacacaataatagtgggagactttaacaccccactgtcaatattagacagagcaatgagacagaaaattaacaaaaatattcaggacttgaactcagctctggaccaagcagccctaatagacatctatggaactcttcaccctaaatcagcaaaacaatctctccaaccatagtgcaatcaaattagaatacaggattaagaaactcactgaaaactgcagaacttcatggacactgaacaacctgctactgaatgactaccaggtgaagacacaataaaccagaatctctgggacacagataaagcagtgtttagagggaaatttatagcactaagtgcccacaagagaaagtgtaaaagattgaaaatcgacacaaaaacatcaaaatgaaaataactagagaagaaagagcaaataaatttaaaagctagcagaagacaagaaataactaagatcagagcagaacttaaggagacagagacaagaaaaacccttcaaaaatcagtgaatccaggagctcattttttgaaaagattaacaaaatagatagaccactagcgaaactaataaagaagaaaagagagaataatcaaatagacacaataaaaaaatgatataggtgatattaccactgatcccacagaaatacaaactatcatcagagaatactataaccacctcaatgaaaataaactagaaaatctagaagaaatggataaattcctggacacatacaaccttgcaatgctgaacaaggaagaagtcaaatccatgaataggccaataacaagttctgaaattgaggaagtaattaatagcctatcaaccaaaaaaagcccaggaccagacaaattcacagctgaattctaccaggggtacaaagaggagctggtactattccttttgaaactatcccaaacaataaaaaaagaggtaccactccctaactaattttatgaggccaacatcatcctgataccaaaacctggcagagacccaacaacaacaacaaaaaaaaaagaaagaaagataagaaagaagaaagaaagaaagaaagaaagaaagaaagaaagaaagaaagaaagaaagaaagagaaagaaagaaaaagagaaagaaaaaataaaattttaggccaatatccctgatgaacatcgatgcaaaaatcctcaacaaaatactagcaaactgaatccagcagcacatcaaaaagcctatccatcatgatcaagtcagcttcatccctgggatggaaggctgtttcagcctatgaaaatctatatacataatccatcacataaacagaaccagtgacaaacaccacataattacctcaatagatgcagaaaaggcctttgataaaattcaacactccttcatgccaaaaactcttaataaactaggtattgatggaacgtatctcaaaataataagagctatttatgacaaacccaaagccaatatcatactgaatgggcaaaagctggaaggcttttctttgaaaactggcacaaacaaggatgccttctctcaacactattaaacatagtattggaaattttggcctgggcaatgaggtaagagtaataaataaagtgtattcaaatagtaagagaggaagtcaaattgtttctgttttcagatgacatgattgcatatttagataaccccatagtctcagaccaaaatctccttaagctgataagcaatttcagcaaagtgtgagaatacaaaatcaatgtgcaaagtttccaagcattcctatacacaaataatagacaaacagagagccaaatcaagcgtcaattctcactcacagttgctacaaagagaataaaatacctaggaatataagttacaagggacttgaaggacctctttaaggagaactgcaaaccactgctcaagaaaataggagaggacacaaacaaatggaaacacattccatgctcatggacaggaagactcaatatcatgaaaacggcaatactgacccaattaatttatagattcaatgctatccccaccaagctaccatagactttcttcaaagaattagaaaaaactactttaaatttcttatggaagcaaaaaggatcccatatagccaaaacaatcctaagcaaaaagagcaaagctggaggcatcatgctacgtgacttcaatctatactacaagatgacattaaccaaaatagcatggtactggtatcaaaacagatatatagaccaatggaacagaacagacgcctcagaaataacaccacacatctacaatcatctgatctttgacaaacctgacaagaacaagtgatggggaaataatttcctatttaataaatgttgggttgggaaaactgggtagccatatgcagaaaattgaaactggaccccttccttacacctcatacaaaaattaactcaagatggattaaagacttaaatgtaaaacctaaaactgtagaaaccctagaagaaacctaggcaataccattcaggacataggcatgggcaaagacttcatgactaaaacacaaaaagcaatggcaacaaaagccagaattgacaaatgagatcaaattgaactaaagaacttcggcacagcaaaagaaactatcatcagagtgaacaggcaacctacagaatggaagaaaatttttgcaatttatccatctgacaaaagtctaatatccagaatctacaaggaacttaaacaaatttacaagaataaaacaaaaaaccgtatcaaaaagtgggtgaaggatatgaacagacatttctcaaaataggacatttatgcagccaagaaacatatgaaaaaagctcatcatcactggtcattagagaaatgcaaatcaacaccacaataaaataccatctcatgccagttagaatggtgaacattaaaaagtcaggaaacaacagatgctgaaggggatgtggagaaataggaacaattttacactgttgatgagaatataaattagttcaactattgtggaagacagtgtggtgatttctcaaggatctagaaccagaaataccatttgacccagaatcccattactgggtatatacacaaaggaatatatatcattctactataaagacacatgcacacatatgtttattgcagcactattcacaatagcaaagacttggaaccaacccaaatgcccatcaatgatagactggatgaagaaaatgtggcacatatacaccatgaaatactatggaaccataaaaaagtatgagttcatgtcctttgcagggacatggatgaaactggaaaccatcattctcagcaaagtaacacaggaacagaaaaccaaacactgcatgttctcactcataattgggagttgaacaaatagaacacatacagtgagaggaacatgacacaactgtgcttgtcagggggtggggtctagaggagggatagcattgggagaaatgcttaatgtagatgacaggttgatgggtgcagcaaaccacgtggcacgtgtatacctatgtaacaagcctgcacgttgtgcacgtgtcccagaacttaaagtatgataacataattaataaataaaaaaataaaaattagaaagtttgaagctgtgtatgtgtgtgtctttccacgtgtattaggaaaatgtaattctgtgagtatgcttagagttgaggcctgtttaaatttcatcctgggactgaatatgaaaggagactttgtacttgcctaaataattatttgagaaaaccaaaggctttcataactactactcagccctgaaaattccaaagtctagctctaaagacaattccaaagtctttgctgatgctctctcacagagtaatgagtcacagagctagggattgacaaaaatgatgtcagcaaagttcatacatgaagtcctcatttcacatttatgtggccttttgtgccttccctttccacacccaccccctagagccctcaagttagatgaaatccccttggaacaaggaaaatgtctgataagtagggttggacaaatagagagacccaaggccttgttttcaaaactgaagattctgaggttcttcttggctgctactagctttctgctgctaccactcatgtactagaggagcatttaaagatttttctaaaacctctgacttctggggtatagagcaattggactgggaaaatgggacacatcagatgggaactcccttttttgcatcactaaatctatttataactatacctattctttctacttttttttctgttacaatggaggaacggtttatactcctttctaagaccaaaatttttacctgtattttggatcccaatccctctcaccttatcaaagtcttcacttcttcggtttccactcacactcccctcacatctttttccttattggatcatcatcatcatcctacacacatattctagtatctcacacttacaaatacattattccttcatctcacatttccttttagctactctctctagctatttatctgttccacttagcaaaacttctcaaaagagtcatttggaagtattgtctctatttctttacctgtaagtcattcgttacttgattctaatgaaaattctctggttcagctcgccaatgatcttcatgttgccaaatccgaaggatatttttctgactttaaattactgaacctctcaacaacttttaaatactgctcacttcactcctttaaaaaattaatgggataagaacacttaccagtatatttaccttcttaacaatttttaagtgtatgtacattgttgcctactataagtgcaatgttttacagcagatctccagagcttattcatcttattcaactgaaagttatgctcattgactagtaactccccatttctctttcccccattctctggcaatccccattccattctttgattctatgactattttagatacctctgataagtgaaaatatggagtatttgaatctctgagactggcttatttcagttagtataatgttctcaaggttcatccatgttgtcttatatttcaggtttttaaaagctgaatagtcctccattgtgtgtatataccacctttatttatccattcatttgtcaatggacatttagattgcttgtctatcttggctattgtgaatagtgctgaagtgaaataggagtgctgatatattttcaaaatcctgattttaattcttttggataaataccaggaaggggattgttggatcatatgatagttctatttttaatgtttagaagtattttcaaactgtttttcatagtggttgcaagattttgcattcccaccaacagtgtttaagggttccaatttttccacatcctttccaaaatttcttattttttgtgatttttattttaaataacagccatcctgacaggtgtgaggtaatatctcattgtgcctttgatttgcattttcgtgattactagtggcattaagcattttggggacatttgcatgtcttcttaggacagatgcctattaaaatatttagcccattttaaaattgggttattattattattattttactattgattcgtaggagttccttatgtatattggagattaaccccttatcaaatatttagtttggaaatatctttctctgtaaattggctttttactctgttgagtgttttctttgctgtgcagaagctttttagtttgatgtagttttacttgtttatttttatttttgttgcctgtgcttcttgtgtcatatccataaaatcattgctaagaccaatgtcatgaagacttgcccctgttttcttctgggagttttgcagtatcagatccaatgtttaagtcactaatccactttgagttgatttttgtttatagtgcaagataagggtctaaatttcttctttttaaaggcctaattgacaaagttgtgtatatttacagtgcataacatgatgttttgatatgtgtatacattttgaaatcattaaatcaagttaattaacagattcatcttctcacctacttttttgtgctaagaatatttaatatctaatctcttagttattcccaaatactatatacaacacattatttattatttgctacagtctccatgctgtacaatagatctccagaacttattctttccatctaactgaaactttttactctttaatcaacatctccccattaccctcccatgctccaacccctgaaaaccaccattctactctctgcttctgagtttgacttttttagtttccacgtataaatgagatcatgagatatttgtctttctgtgcctggcttatttcacttagtgtagtgtcctccaggtttatccatattgtcacaaatgacaggatttctttcttttttagtctgcaaaatattctatattccatatttccatatatatataaagcactttatcaattaatgaacacttaagttgattccatatcttgactattgtgaataatgctgcagcaaacgtagaattgcaaatagctctccaacatactgctcttgtttactttggatatatacccagtagtaggatagctggatcatattgtagttccatttttgatttcttggggaacctccatactatctttcataatggctatactatctagttttatggttttgaatttgtatatccagtttttttatatgccaattgttgaagtgactatcctttccccattgtgtattcttagcacttttgttgaagattagttgaccatatatatagggatttatttctgggcactctgttttttttctattgaactatatacttgtctttatgccagtaccatactgttttgattactgttgatttgtaatatattttgatatcagtagtaaacatttccaaactcactttatgaggccattactctgataccaaatacagctaaaacatcacaagaaaaaaaactatatttcaatatccctgatgaatttagacgtaagaatcctcaagaaaacactagcaaatcaaatgtaatgacacagtaaaagaatcatatgccatggccaagtatgattgatttctaggatgcaagaatggttcaacatagaaaaatcaattaatgtaatatgccacattaacagaataaaggttaaaaattacatgatcatctcaatagatgcagaaaaaacatttgacaaaattcaacatcattttatgatagaaactctaaacaaaatagaaatataaataaattacctcaacataatagaaacaatatatttaaagcccatagttagcatcatattcaatgatgaaaaactgaaagctcttcctctaagatcaggaataagacaggaatgtccactctcaccaattctattcaacatagtactgaaagtccttgccagagcaattcagcaataaaaacaaagccatccaagtaagaaaggaagaggtagtattatctccactgatgacataactttatatgtaaaataccctaaagactctacaaactatttgggctaataaacaagttcagtaaagttgcaggacacaaaatcaacatacaaaagtcaattgtgtttctacacaataatgacaaactatctaacaaggaaattaggaaaacaatcccatttataatagcactaaaataataaaatatttgataataaaattaaataagaaggtgaaatacttgtttactaagaactacaaaatattaataaagaattgaagaggacacaaacagaaagacattcatgtttatgtattggaagacttaatttttaaatgtccaaactacctacagagatctaccgattcaatggcatttctatcaaaattctaatagtatttttttttacagaaatagaaaaaaattatagaattcatacatagctaccaaagatcataaatagcaaaaatcagtcttgagaaagaacaacgctactcgttttaaaatcgggacatggatgaaattggaaatcatcattctcagtaaactatcgcaagaacaaaaaaccaaacaccgcatattctcactcataggtaggaattgaacaatgagaacacatggacacaggaaggggaacatcacactctggggactgttgtggggtcgggggaggggggagggatagctttaggagctatacctaatgctaaatgatgagttaatgggtgcagcacaccagcatggcacatgtatacatatgtaactaacctgcaaattgtgcacatgtaccctaaaacttaaagtataataataataataaaataaataaataaataaataaataaataaataaataaaataatttattcttttagcttccatgatgccacacttccttggcttttttcttaccttcacttaggcagtggggtagtttccttgcttcatctccttaaactcagggcttgtttagggcactcatttgagtccacatctcccttcaccatctctctctagttgatgctgtgtagccccatggttttaaatttcatttatattcacagcttacaaatatgtatccccaggtttgacctttaccttgagtttcagatttgtgtatctaaatgcccacacgtcgtcctaatatagatgtctcacagatatgtcaaacacaaacatgaccaacttagaactcttaagtcttaccttaaaacctcttcctcacagtattaatcatcacagtaaagacagtattcacccgttcgctcaagccaaaaaataaatgcggtccttgaatgctctcttcctcatctcccacatccagcccattagaagttcctgtcaattctacctccaaatataaagttcaaagagaaagaaataaaggacattatgattggcaaggaagacatcaaattttcttttcatatggataatatgatcttatgttttttattatttatctatttagtgatttgattttgcatgaacattattagtgcattttttattttaccatctacatcaattgttaaatttattaaaaattgggtacaaggtacacatgaactaagggagtttacctaata

SEQ ID NO: 663 - DNA, 17800 bp, Homo sapiens
tgtgaatattttccaaaatcataactactacttagaggtggcctcagtctattaattattatcaacctggaagctgtaaacaatgttaccggtcttgaggtttcatatttactttaaaagaaagtgggggccgggtgaggtggctcacgcctgaaatcctagcactttgggaggctgagatgggtggatcacctgaggtcaggagttcaagaccagcctggccaacctggtgaaaccctgtctctactaaaaataaagaaattagccaggtgaggtggtgcacacttgtaattccagctactcaggaggctgaggcaggaggatcgcttgaacccaggaggtggaggttgcagtgaaccaagatggtgccactgcactccagtctgggtgacagagcgagactccactcaaaaaaaaaagggggggggggtggggagtggttaggccttttctaatattccttacctctgacaaaattattcattttctcactatttctggtacacagcacttaagtcactgtcttataatctgtatacatgtctgactctgaaaaaagttcactttttgcatcctaataaccaaacacaagacattctatatcccaacaggattgtaatccgttccaaatgtatactaaaccttaggctgatgctcagtcttaaagcagaggtaaaatgacaattttctaatttcttaaacttcttatatatttaaaagtttaagacaaagctaaaagaccaacaaaccccaaatcaactaattaatactttacaattttaattgctcttttgctccattattcaatttcaaagtactagtgagaagaactgattcaagatactgaaaattttctaaggtataataatttgttaatccatcaaaccatacttttcttttctgttctttttttttttttttctttgagacagagtctcgctctgttgcccaggctggagtgcagtggcagtctcggcttactgcaacctccacctcctgggttcaagcaattctcatgcctcagcctcctgagtagttggaattataggtgcacactaccgtttctggctaatttttgtatttcttgttgagatgaggtttcgctatgttggccaggctgaatccatcaaaccataaatgaacattgtctttctttttttttcttttgagacaagagtctcaccctgtcatccaggctggagtgcagtggcaccatcttggctcactgcaacctctacctcctgggttcaagcgattctcctgcctcagcctccagagtagctgggattacaggcgcccgtcaccatgcctggctgttttttttttgagacagagtctcactctgttgcccaggatggagtccagtggtaccatctcggctcactgcaacctctgcctcccaggttcaagcaattctccggcctcagcctccccagtagctgggattacaggcgtgcaccaccatgcctggctaatttttgtatttttagtagagacagggtttcaccatattggccgggctggtctcgaactcctgatctcaggtgatccgcctgcctcagcctcccaaagtgctgggattacaggtgtgaggcagcacgcctggccgtctggctaagttttgtatttttggtagagacagactttccccatgttggccaggctggccgcgaactcctgacctcaaatgatccacctgcctctgcctcccagagtgctgggattacaggtgtgagccaccacacccagcccataaacgaacattttcaactaaaattttaggattaaaaaaaataaagtttgagtaatatttttctttcagtcttcccccgccccgccgcccgccccctgagatggagttttgctctaattgcccacgctggagagtaatcacacgatctctgctcactgcaacccctgcctcctgggttcaagagattctcctgcctcagcctcctgagtagcagggattacaggcacccgccaccacgctcagctaatttttttttgtatttttagtagagatggggtttcaccatgttggccaggctggtctcgaactcctgatctcaggtgatctacccgccttggcctcccaaagtgctgggattacaggcatgagccaccacgcctggcctcagtcttctttcttctcatatggactaggtgtatattgttaatctttcagcccaccatttcatggttgaatagattaattctcccaggtttgggctggatgtgaagcagtaagtatattttccatagtgcataagaacattttcccaaatatccttcaattaaaatcagttaaaatcaaaagcttaatatttttttagaatgctttccttaaaatctctctaatcatcaacatagtataataaaactgggaaagacatacacaaacatttactaaagatagaattttcagtggttttgaatttttttctttatacttatttgtattctaaattttctttaatttatattccttttgcaatcagaaaaaaatatatttaagtttcgttttttttcccttttttattagagacagggtctcactgtgtcgtccaggctggagtgcagtggtgtgatatcagctcactgttgccttgacctcctgggctcaattgatcctcccacctcagcctccctggtagctgggaccacaggcatgcatcaccatacttggctaattttttgtgtgtatttttttgtagagatggggttttgccatgttgcccaggctggtctcaaactcctgggctcaagcaatctacccatcacagcctccaaaagtgctaggattacaggtgtgagccaccatgcccagctgattcttgtatatcaatgtcaggacaccctggctgagaagcacaattccaggaacattacatttgttcaccttgttgatttgttccagagtcagtgcttatgtactcaggtgggtaaactatgtttagtcatattatgaaatttagattcttacttatctgacatcgcttttacctgtctttgcagcttacagaggcatccacttttagatataagaaaataaaaattagcttgggccaagaaagtaaaaatattccttgtcattcaagagaatggaacaacacaaacataaagcagctgcaaagtccacaggaagtatttttccctagcacacacttcagctgtaaaatgtcaaaatatccccatctttgagtaattactgttttcttactgaggaatattggtctttaaatagacttcttgcaattatatgagtaaaaatgaaatattcttgcttggcagatctaagtcactcaatttacacgtataatttctaagtagcctcaatttacaaccaaggtatagagcttcaaagaagaagtttttgaagacaaaaatcccacatttatgttaactttgtagtttccaagcaaacagaaccctgggtctgattgacagttcagacctgatgttgacccctttacacagccttacactgcttttagcctatcaaaacaatgctttgtttaaatttcacataaactccactattctcccaaatcctattacaactctatcttttctttgttaagatgttccatggttcttctaatgtacagtattcctcatattaatgagccaataaacctggccctatcagactacagatttgtccctagtagtctttggtttattgggctggagaggatgatacagtaatgattttcaaaggatattgtgacttgcattaagagaacagccccagccaaatgctgtagagagaatactagactgtgagaaaacagacaaaatacagcaagaaagacttattgtaaaaggatactaaacagaagaacaatgtgtgtttcagctacaaactgggcttgactgcttccatggatataattctaggagggaaaaaagacaaaatggaatctttaagtatacattaaatgttggtatgctaaccctaaaacggggtattttaaactatgaaattattaattcacctgataaaccatgtgacatactccgggtctgtggcattcatcagtaagtctggttactataaggctatttttgtattatctattctcgatttgtcttttcattgtactaatactatgtttatttttgagacagggtcttgctctgttgcccaggctggagtgcagcggcatgatcatagctcattgcaatcccaaagtcctggctccggtgatcttcctgcctcagcatcccaagtagatgggactacaagtatgcaccaccatgcctgctcagctaatttttaaattttcattagaaatgacatattgctatgttggccaggctggtctcaaactcctgggctcaagcaatcctcccacctcagcctcccaaatgcttgaatactgtacttatattttcaacaacagaatatgtcagaaaactagttgttgttgttgttttttcttttcttttttgtttttcatagagatgacgtctcactatgctgcccaagttggtcttgaactcctggcctcaagtggtcctcctgcctcagcctcccaaagtgccaggattacaggtattagtcaccacacctggccccattttttttttaaggagatggatcttgctatgttgtccaggctgggctagaactcctggattcaagtcatcctcctgcctcagcctcccaagtagctgggactacaaatgcaaaacactgcacctgggtgagaaaactagtatttaagtgtacaagaccatgaggtacaataatgtaggctccatgaagacagggatcatgtttttcttatcactatatttaataataattagcacagtgcttagaaacagtggatgctcaggtacttgatcaatttttctatttagttgaaggctgtctttcattcttagctagcttggttagaaggattcaccaaatgggaaaaggaacttcccacttttaagagcactgcggccgggtgcggtggctcatgcctgcaggcctgtattcccagcactttgggaggctgaggcaggcgcatcacctgaggtagggagtttgagaccagcctgaccaacatggagaaaccctgtctctactaaaaatacaaaattagctgggcgtggtggcgcatgcctgtaatcccagctactcaggaggctgaggcaggagaatcacttgaaccagggaggtggaggttgcagtgagccgagatcacgccattgcactccagcctgggcaacaagagcaaatctccgtttcgaaaaaaagaagaaaaaaaaaaagagcactgcatggtcttatcagtgatggaagcttgttaacacaagagagattgaaaagtgaagactaaatccagctccttcatatgctggcactgttctcacagggtaataatcattgagttaactttggtctacaaaggaaagaaatcccagacttcccttaccacatgtcccgtgtggggattcttatgggcatatggtggtcctcttatatggttccacatttgaccagatgtcatagcaagcacaaaacactaggaaacaaaaaaataataaaatattcatggtcaaactgttcttgtcttgattagataacaggaatatgaaaatgtgcatctgtttagttaagacatagaattttttgcagataaatgatttattaaggcttatatttcatcccaaggatcacaattcgataatacttcaaaaggaaaacactattttttttttttgacatggagtctcgctcttttgcccagactagagtgtagtggcgcgatctcggctcactgcaacctccgcctcccaggtttaagcaattctcctgcctcagcttcctgagtagctgggactatagaagcatggaaccacgcccagctaattttgtatttttagtagagacagggtttcaccatattggccaggttgatcttggtctcttgacctcgtcatctgcccacctcggcctcccaaagatatgggattataggtgtgagccactgcgcctggccaggaaaacactatttaaaaattataactatgcagacacaagtttcaaaattgaatactgaaaaggctttttagaataaaattttcaggctgggcatggtggctcatacctgtaaccccagcactttgggaggctgaggtgggcgggtcacctgaggtcaggagttcaagaccagcctggccaacatggtgaaaccccgtctctcctaaaaatacaaaaaaattagctgggcgtggtggcacacgcctgtaatcccagctactcgagaggctgaggcaggagaatcatttgagcccaggaagcagaggttgcagtgagccaagatggtgccactgcactccagtctgggtgacagaccaagactccgcctcaaagaaaaaaaaaaaagaataatattttcagaacaactagagattttcatagagatgacagtctgtcatttaggttgaataaaaggcaggtacaatcagttccttgaagttctggccatccttatgagataatgaatgaaacaaactgattttaagacagaaaattaaaatatataaaactattttcctcaggtaagaaataaaatgctacttctcacataaataaaagcttacctaaaaatacactattaggaattttattcaaataattttttgtcttctgaaattcactcaccaaagctgcaaaagcccatccagttttattaaagagaaattccatattacttcttcgaagatacacaagtccaccaataacagccaaaagcaatcccaacataaggggaccagcataatttgggggtctaatcactctaatctaatggaaaggagagaaaaacatgttaaagtataaaatttttttactaattatatgggtcaaaataaaatctgaaatgaaagcaatcaaaattattgtggttactttcggaaaaatgatcctttttatgttatcccaatcaaactagtctataatataacctaaaataggatagaataggtacaatattctatttaaccacaacataacatcttttagattaagaaggatttgccaagtacaactagataatccatggacttaaggtcgaaagagtggtttccatgctgaattcaatagggtaatagagagtgttctgtaatttcactcattcatcaagatgattctgtttaatgctacttatgaagtgactgccaaactagtaccacctcagtgatatggggacaagactaattagggcctcccagtaagattcaaaggggataatggccaagaaacagtctacatagttgggaaacttacattgacatcagttctgtcggcgatccaccgggcaatctgctcagctgaaaaaccccgcacctgtaactcatatgtatcaccccgtttgggtttcccttttgcaggaaagttgatgaaagttggagctgaattcatgtttagctgaataaaaacgagccatgaaaatatacattatcaggaaaataatcttaattgcagttaacatcttgaaatttaggcattttacaaagatgaggaggcctgggtttaggtaggttaagtgatttggtttgcccaaggaaagtggtaagtggtggagcaggctttaaaagcaaagctgcctgtgaccttaagtattacatactactcaccaaatacacattcctcgctaagaaacctgtattttactccactagaatggaaactttgccataccacagatattttaatctgttcagagattatgcaaaatgaatacatttatgagcactaaaataatcttatgtagctgagtaagctccaaatagagtatattctcaatttggaggaaccaagataataaaataatgctctaaaacagcagtgaaaagcaatacaaaatggtggctatatgcagaaatagtctattctaagaaggtccataaatgtttactgatgagcaccacatttctctattctccatcatgacatcatgatatatttgagaagacaacaccggaaatactaaggtaaagaaaccataaccatctcatctgcattatatctttttttatttttttgagatggagtctcgctctgtcacccagactggtgacaatcttatagagattggcttgcacaaatcaatttttatttatttatttgtttatttttgagatggagtctcactctgttgcctaggctgaagcacagtggcaggatctcggttcactgcaacctccgcctcccaggttcaagtgattctcctgcctcagcctcccaaggagctgggattacaggtatgtgccaccacacccagctaatttttgtatttttagtagagacaggggttcaccatgttggccaggctggtcttgaactcctgactgcaaatgatccccccgcctcagcctcccaaagtgctgggtttacaggcgtgagccaccgtgcctggccttacaattataattttaaaacctcagccaataaaataatccaactcccatgctttgattctttagttaaaatccttctaacagtaagttttcaagctttcccataaggtgagagcatgtactgactgttgcttatcattattttggtctctttggctgtataatgtggtaaattaatgaattaatagattactcctttggttaccaatgtccatagatttatatgccttggtcagtaggcacaaaatccctagaggtagataaattctggctatcctgttaaaattcaatttctgtgattgcaaagctaggaaccaaatcttatacaatgttcagtctaccaaatgctgcccaaattttaggccaaactctttattcaatatttgtttagttacaccacctctacatttttgaaaatgtgtataaaaaataaaaactggccgggtgcggtggctcacacttgtaatcccagcactttgggaggccgaggtgggcagataatgaggtcaggagttcaagaccagcctggccaacacagtgaaaccctgtctctactaaaaatacaaaaattagctgggcgtgacggtgggcacctgtaatcccagctactcaggaggctgaggcaggagaatcgcttgaacccgggaggcggaggttgcagtgagccgagattgtgccactgtactccagcctgggtgacagagctagactccgtctctaaataaataaataaaaaataaaaaataagtaacatataaatacacttctcttgtaaaaaatatttttaaaaacattacatggttataaggaccaattctagtacattctggcagccacagttaccatttacagatatttttgaatttattcatatatatgtttataccaccagaaaacatataatattgctgttttaacataaatggtatcatattaatggtattttcctggttgtcttcctttttagcaactaaaaataatgttgcagtgaacatccttgcacatatctccctgtacccatgtgaaagtgattctctagaaatgggattgttaggtcatgggatagaaatattttttaattaaaatggatatagtgcccaggcacggtggctcacgcctgtaatcccagcactttggaaagccgaggcaggtggatcacttgaggtcaggagctcgagaccagcttggccaacatggtaaaaccccatctctactaaaaatacaaaaattagctgggtgtggtggtgggtgcctgtaatcccagttactcaggaggctgaggcacaagaattacttgaacctgggaggcggaggttgcagtgagctgagattgcaccactgcatttcagcctgggtgacacagtgagactctgtctttaaaaaaaaaaaaatggatatagccaaattgtcttccaaagtggctgtgccaaaatatacttctacttaacaatgcagtaatgtatccatttccctacatccttgccaaaagttgatgtgatgggtgaagactgtactttatcattatcatactattaatttgtgtttccctgtttactaataaaacatctttaaaacaaattagttatctgaaaacatctttgtttttttttcttgagaaggagtctcactctgttgtccaggctggagtgcgttggcgcaatcttggcccacacaatctccgcttcctgggttcaagcgatcctcctgtcttaccctctcaagtagctgggataacagggatgcgccatgacatccagctactttgtttttgtattttcagtagagacaaggtttcgccatgttggccaaggtggtctcgaactcatgacctcaagtgatccgcctgcctcagcctcccaaagtgctggcattacaggcgtgagtcaccatgcccggcctgaaaacatcttgtagcccaacgatacaatcaacagagtagaaagaaaacctgtgaaatgggaggaattatctgtaaatcatttatctaataaggagttaatattcagaatagtctgggcatggtggcttatgcctgtaatcccagcactttgggaggccaagacaggtgtatcacttgaggccaggagtttgagaccactctggccaacatggcgaaaccctgtctctactaaaaatacaaaaattagccaggtgtggtggcgcatgcctataatcccagctatttgggtggctgagacacgagaattgcttgaacctgggaggcagaggttgcagtgatccaggactgcgccactgcgctccagcctgggcgacagagtgagactctgtctcaagaaacaaacaaacaaaaacaaaataaaaacaacaacaaaaatttggaatatataaagacctcctacaactcaacaacaacaaaaaacttgatttaaaaaatgggcaacacaggtgggtgcagtggctcatgcctgtaatcctagcacgttgggaggccaaggcaggtggatcacctgaggtcgggagtccgcaaccagcctgaccaacatggagaaaccccgcccctactaaaaatatgaaaaaaattagctgggcctggtgacgcatgcctgtaatcccagctactcgggaggctgaggcaggagaatcgcttgaacccgggaaacggaggttgtggtgagccgagatcgtgccattgtactccagtctgggcaacaagagtgaaactctatctcaaaaaaaaaaaaggcaacacacacacacaatgggcaaagaacttgacatttctccaaagaagatatacaaatggccaacaaaacacatgaaaaaatgttcaatattactatcattatggaaataaaaaacaaaaccacaatgagataccacctcacactcataaagatggctattatccaaaacaaacaaacaaacaaacaaaaaaccccagaaaacaagaagtggttgcgagcatgtggagaaactggaaaccctgtgcaccattggtgggaagtaaaatggtgaatctgctatggaaaacagcatggaggttcccccaaaagattaaaaatagaattaccatatgatctagcaattctacttctaagtatataaccaaaagaactgaaagcagggtcttgaagagattatttgaacactcgtgttcatagcagtattattcacaatagccaaaagctggaagcaacctaagtatccactgacagatgtatgggtaaacaaaataaggtgtatacatacaatgcaatattattcagctttgaaaaggaaggaagttctgacacatgctataacatggatgaacattgaggacatgatgctaagtgaaataagccagtcacaagaacacaaatactatataattccacttatattaggtacctagagtagtcaaattcatagagacagaaagtagaatggtggttgtcaggaactgggggagtggggaactgaagttgtttaatggctataaagtttcagttttggaagatgaaagaattctggagattggttgtacaacaatgtgaatgtatctagcactactgacctgtacatttaaaaaatggtaaacataataaattttatattatatatatttacaaaacaaccccaccaaaaccccttgtagactctgaaattccttggaggttaatgaaccaaaataagatacactattttttggtaggtatcagttttcacatacgcttagcttttgcatactgtggcatatgacactgttacttagagaaagatttgaatctcttccacagatggacacactaccatccttatacctttggctctaaaatctagctctaaaatagagtaatggaaattaatattaaaaactattcaaggtacgaaagtgtacgtaacaaaaacaaaaatagacaaatgggactatattaagctaaaaagcttctgcaaagcaaaggaaacaacaaagtgaagagacaatctgttgaatgggagaaaatatttacaaactattcattcaacaaggaactaatgtccagaatatacaaaaaattcaaacaactctaaaaagaaaataaaacaaaaacaaaaacaaaaaaaattcaaatcactcaacagtaaaaaagcaaataatcccattaaaaagtggacaaaggacatgaatagacatttctcaaaagaagacacacatggccaacaggtgtatgaaaaaatactcaacatcactcatcatcagggaaacgcaaatcaaatctacagtgagatatcatcttctcccagttagaatggccattattattattattagaaaagctccttttctgctcatctgtctgttgcctccttgcaatacattttcctactttctctaataaatctgcctttctttaccttaaacgaacaaacaaacaaaaacagatgcaaggatatggagaaaagggaactcacggccaggcacggtggctcattcctataatcccaacactttgggaggccgaggcgggtggatcacctgaggtcaggagttcgagatcagcctggccaacatggtgaaaccctgtctctactaaaaatacaaaaattagctgggtgtggtgatgtgcgcctgtaatcccagctgctcaggatactgaggcaggagaatcgcttgaacccaggaagcggaggttgcagtgagccgaaatctgcactccagcctgggcaacagagtgagactccatctcaaaaaaaaagggaactcatacactgttggtgggaaattaaattagtatagccactatgaaaaacagtataaggccaggtgtggtggctcacgcctgtaatcccagtactttgggaggccgaggtgggcggatcacgaggtcaggagatcgagaccatcatggctaacacggtgaagccccatctctactaaaaaatacaacaaaaattagccgggcgtggtggtgtgcacctgtagtcccagctactcgggaggctgaggcaggagaatggcgtgaacccgggaggcggagcttgtagtgagccgagatcacaccactgcactccagcactccagagggagactccgtctcaaaaaaaaaaaaaaagaaaaacagtataaagatttcccaagaaactaaaaatagaactagcatttgatccagcaatgccactactgggtatgtatccataggaaaggaaatcagtatatcaaagggatacctgcacccccatgtttactgcagcacaatagcaaagttatggaatcaacctaagcatccatcaacagacgaacagatcaagaaaatgtggtattaggccaggcgcagtggcttgcgcctgtaatcctaccactttgggaggctgcggcaggtggatcagttgagctcaggagttggagggagaccagcctggccaacatggtgaaaccccatctctactaaaaatacaaaaaaattagccaggcgtggtggcgcacacctgtaatcccagctactcgagacgctgaggcaggagaatggcttgaacctgggaggttgcagtaagccaagattgtgccactgcactctagcctgggcgacagagaaagactccatctcaaagaaaaaaaaaatgtggtgtgtatacacaatggaatactactccaccataaaaaagaatgaaatcatgttacttgcagcaatatggatggaactggaagttattatgtgaaataagccaggcacagaaagacaaatatggcatgttctcatatgtgggagctaaaaaaattgaactcagggaggtacagagtagaatggcagataccagaggctgggaagagtgtatgtgtgtgtgttgtggtgggcggggtgggggggaggggtgcgggagcgggcaatgaagagaggtcagttaatgggtacactcatacagttagaaggagtaagatctaatgttccatagcagagtagcgtgactataattaacaaaaatgtattacatatttcaaaacagctagaagagaggacttgaaatgttcccaacatatagaaatgataaatactcaaggtgatggatactccaactatcctgacttgatcattctatgaatctaacaaaatatcacatgtaccccataaatatgtacaaatattatgttatcagtaaaaaaactaaggtagaaaaaaatgggttttctatttttacaaatcactaacagaagttatgtgttaccttgttaaaataaatggaattaaaaattgtaatttccaaaaataactgcagcctaaatagtagagaattaaaaagcaatttttttttttgagacaaagtctagctctgtcacccaggctggagtgcagcggctcactacaacctcctggctcactacaacctccacctcctgggttcaagcgattctcctgtctcagcctcccaagtagctgggattacaggtgcccgacaccacacctggctaatttttgtatttttagtagagatgggatttcaccatgttggccaggctggtgtcgaactcctgacctgaagtgatccccacgccttggcctcccaaagtgctgggattacaggtgtgagccaccatgcctggcctcaatttcttaaactccagaaattgtttcctttagtctaataaatcctaaatgcactaaccttttaggttacaacatttttataaatgcactgattttgatttgtggagatggctaagtgagactggaatatgaatagcacaatgaatgatatactgtaaaatggaaacattaagccatttttttcaacatttaccgaatacccgttatgtgcttagcactgatagctacaggatatggctctgccattaactaagtagtaactatattcttttatttatttatttatttatttttgagatggagtctcgctctgtcgcccaggctggagtgcagtggcgcgatctcagatcactacaagctccgcctcccgggttcaagccattctcctgcctcagcctcccgagtagctgggactacaggcgcacaccaccatgcccgtctaatttttgttgttttttttttgtagagacagggtttcaccgtgttagccaggatggtctcgatatcctgacctcgtgatctgcctgcctcggcctcccaaagtgctgggattacaggcgtgagccaaccgcacctggctgtaactatattctaagggagactgtcaaacaactacagagctaactctactgtaagacaaaatgtggataaatgtataacagaaatttaaggcaagtgatataacaatacaagaaaaggagtgactcactttttatctggaaaagttgagaaagcttacagggagtatctgaaacaaggcttaaaatgtaagcagaattttgagagtggagagaaagcagacagggaagaaaattgttgtaacccaacaatcaacagtgctgacatacgagagtgcatcaggccaggcgtggtgtctcacgcctgtaatcccagcactttgggaggccaaggcgggcagatcacccgaggtcaggggtttgagaccagcctggccaacatggcgaaacccctgtctctactaaaaattaaaaaaaattagccaggtgtggtggcgcgtgcctgtaatcccagatactctggaggctgaggcacgagaatcgcttgagcagaggttggcagtgagccgagatcacgccaccgcactccagcctgggtgacagcaagactccacctcaattaaaaaaaaaaaaagagtgcatcaaagaatatgattatgggaaaggtgtgactggagtaaagagcacatgaaattaggactaaggaattctggcttcagtctatacactactcctttcaaaagtgtgttctatggaatctagccaaatgctccattaagtggtccaataatatgagaaattctgtgtattagagcccccattggaaagtataacacatatcagcatcagcatgttaacatctctgatctctcaaaagctgtgttgggagacaattcttcatgagtttctcatgtttctgcacatcttgtggacaagggccctaactgcctttgttctggacaatcttctcaaggatatttgtatatctttggaagatagttgaaatggccttcgcaaaattatgactgagacagtgaaagagatctaacttaactgactccgacttggttctaacctccaagctgtccttgttcattcctggccataggctgaactaactttaggagaaacttagtttatagtttaaacaaagactgtaacagccctttcccaaagcagacctccttcttgcctgagaactagattgcctttgtaggactaatattagccacaagatgaaaaattatggtttaggagtcatgtagctagaggctacaagattctgaccctccctaaactgctcctaatatcatcgcttgagatattttgcagactctgcacttgatggatcagctgacaccacccagatcaataaactggctcatctgatcttgtggccccctcccaggaactgactcagcacatgaagacacctttaactccctatgatttaatctctgagcaatcagcactcctggctcactggcttccccccacccacgaagctatccttaaaaactctgcaccccgaatgctcggggagactgacttgagtaataataaaactccagtctcccacaaagctggctgtgcatgaaatactttctctattgcaattcctctgtcttgatgaattggatctgtttaggcagcagcaaagtgaaccccttgggcggttacacagtctccctccacagcaaaggggaggcacacttactatccattacagaaaatgtgggttcccagagcttggtgttcctctcccataatgcagcccattggccctctttgttattgttgttttcttaagagttggggtctggctctgctgctcaggctagagtgcagaggcacgatcacagctcactgcagcctcaaactgatctcaagcaatcctcctgatccagccttccgagtagctgaccactggccctctttggattgccctatgggaaatggggtttggggaacctatgacattttggctacttgttgtgagtagtaaagtcctttaacttgagccaggcatggtggcacaagcctgtaatcccagctactcagaaggttaaggtgcaaggattacttgagcccaggagttcaagactagccagggcaacatagcaagacccaatctcaaaaacaaacagcaaaaagtcctttgctggactctgactcaggagtgtcatattttctgccagcatccatgaaactgtggcaggttaacttgttagcttgcaagtagggtaagaacttagatccttcccagcttttgaaccctgaagtaaaaagaaaacttaattttgtttaaaccagggtttcccaagtttatttttt

SEQ ID NO: 664 - DNA, 6392 bp, Homo sapiens
tgtgaatattttccaaaatcataactactacttagaggtggcctcagtctattaattattatcaacctggaagctgtaaacaatgttaccggtcttgaggtttcatatttactttaaaagaaagtgggggccgggtgaggtggctcacgcctgaaatcctagcactttgggaggctgagatgggtggatcacctgaggtcaggagttcaagaccagcctggccaacctggtgaaaccctgtctctactaaaaataaagaaattagccaggtgaggtggtgcacacttgtaattccagctactcaggaggctgaggcaggaggatcgcttgaacccaggaggtggaggttgcagtgaaccaagatggtgccactgcactccagtctgggtgacagagcgagactccactcaaaaaaaaaagggggggggggtggggagtggttaggccttttctaatattccttacctctgacaaaattattcattttctcactatttctggtacacagcacttaagtcactgtcttataatctgtatacatgtctgactctgaaaaaagttcactttttgcatcctaataaccaaacacaagacattctatatcccaacaggattgtaatccgttccaaatgtatactaaaccttaggctgatgctcagtcttaaagcagaggtaaaatgacaattttctaatttcttaaacttcttatatatttaaaagtttaagacaaagctaaaagaccaacaaaccccaaatcaactaattaatactttacaattttaattgctcttttgctccattattcaatttcaaagtactagtgagaagaactgattcaagatactgaaaattttctaaggtataataatttgttaatccatcaaaccatacttttcttttctgttctttttttttttttttctttgagacagagtctcgctctgttgcccaggctggagtgcagtggcagtctcggcttactgcaacctccacctcctgggttcaagcaattctcatgcctcagcctcctgagtagttggaattataggtgcacactaccgtttctggctaatttttgtatttcttgttgagatgaggtttcgctatgttggccaggctgaatccatcaaaccataaatgaacattgtctttctttttttttcttttgagacaagagtctcaccctgtcatccaggctggagtgcagtggcaccatcttggctcactgcaacctctacctcctgggttcaagcgattctcctgcctcagcctccagagtagctgggattacaggcgcccgtcaccatgcctggctgttttttttttgagacagagtctcactctgttgcccaggatggagtccagtggtaccatctcggctcactgcaacctctgcctcccaggttcaagcaattctccggcctcagcctccccagtagctgggattacaggcgtgcaccaccatgcctggctaatttttgtatttttagtagagacagggtttcaccatattggccgggctggtctcgaactcctgatctcaggtgatccgcctgcctcagcctcccaaagtgctgggattacaggtgtgaggcagcacgcctggccgtctggctaagttttgtatttttggtagagacagactttccccatgttggccaggctggccgcgaactcctgacctcaaatgatccacctgcctctgcctcccagagtgctgggattacaggtgtgagccaccacacccagcccataaacgaacattttcaactaaaattttaggattaaaaaaaataaagtttgagtaatatttttctttcagtcttcccccgccccgccgcccgccccctgagatggagttttgctctaattgcccacgctggagagtaatcacacgatctctgctcactgcaacccctgcctcctgggttcaagagattctcctgcctcagcctcctgagtagcagggattacaggcacccgccaccacgctcagctaatttttttttgtatttttagtagagatggggtttcaccatgttggccaggctggtctcgaactcctgatctcaggtgatctacccgccttggcctcccaaagtgctgggattacaggcatgagccaccacgcctggcctcagtcttctttcttctcatatggactaggtgtatattgttaatctttcagcccaccatttcatggttgaatagattaattctcccaggtttgggctggatgtgaagcagtaagtatattttccatagtgcataagaacattttcccaaatatccttcaattaaaatcagttaaaatcaaaagcttaatatttttttagaatgctttccttaaaatctctctaatcatcaacatagtataataaaactgggaaagacatacacaaacatttactaaagatagaattttcagtggttttgaatttttttctttatacttatttgtattctaaattttctttaatttatattccttttgcaatcagaaaaaaatatatttaagtttcgttttttttcccttttttattagagacagggtctcactgtgtcgtccaggctggagtgcagtggtgtgatatcagctcactgttgccttgacctcctgggctcaattgatcctcccacctcagcctccctggtagctgggaccacaggcatgcatcaccatacttggctaattttttgtgtgtatttttttgtagagatggggttttgccatgttgcccaggctggtctcaaactcctgggctcaagcaatctacccatcacagcctccaaaagtgctaggattacaggtgtgagccaccatgcccagctgattcttgtatatcaatgtcaggacaccctggctgagaagcacaattccaggaacattacatttgttcaccttgttgatttgttccagagtcagtgcttatgtactcaggtgggtaaactatgtttagtcatattatgaaatttagattcttacttatctgacatcgcttttacctgtctttgcagcttacagaggcatccacttttagatataagaaaataaaaattagcttgggccaagaaagtaaaaatattccttgtcattcaagagaatggaacaacacaaacataaagcagctgcaaagtccacaggaagtatttttccctagcacacacttcagctgtaaaatgtcaaaatatccccatctttgagtaattactgttttcttactgaggaatattggtctttaaatagacttcttgcaattatatgagtaaaaatgaaatattcttgcttggcagatctaagtcactcaatttacacgtataatttctaagtagcctcaatttacaaccaaggtatagagcttcaaagaagaagtttttgaagacaaaaatcccacatttatgttaactttgtagtttccaagcaaacagaaccctgggtctgattgacagttcagacctgatgttgacccctttacacagccttacactgcttttagcctatcaaaacaatgctttgtttaaatttcacataaactccactattctcccaaatcctattacaactctatcttttctttgttaagatgttccatggttcttctaatgtacagtattcctcatattaatgagccaataaacctggccctatcagactacagatttgtccctagtagtctttggtttattgggctggagaggatgatacagtaatgattttcaaaggatattgtgacttgcattaagagaacagccccagccaaatgctgtagagagaatactagactgtgagaaaacagacaaaatacagcaagaaagacttattgtaaaaggatactaaacagaagaacaatgtgtgtttcagctacaaactgggcttgactgcttccatggatataattctaggagggaaaaaagacaaaatggaatctttaagtatacattaaatgttggtatgctaaccctaaaacggggtattttaaactatgaaattattaattcacctgataaaccatgtgacatactccgggtctgtggcattcatcagtaagtctggttactataaggctatttttgtattatctattctcgatttgtcttttcattgtactaatactatgtttatttttgagacagggtcttgctctgttgcccaggctggagtgcagcggcatgatcatagctcattgcaatcccaaagtcctggctccggtgatcttcctgcctcagcatcccaagtagatgggactacaagtatgcaccaccatgcctgctcagctaatttttaaattttcattagaaatgacatattgctatgttggccaggctggtctcaaactcctgggctcaagcaatcctcccacctcagcctcccaaatgcttgaatactgtacttatattttcaacaacagaatatgtcagaaaactagttgttgttgttgttttttcttttcttttttgtttttcatagagatgacgtctcactatgctgcccaagttggtcttgaactcctggcctcaagtggtcctcctgcctcagcctcccaaagtgccaggattacaggtattagtcaccacacctggccccattttttttttaaggagatggatcttgctatgttgtccaggctgggctagaactcctggattcaagtcatcctcctgcctcagcctcccaagtagctgggactacaaatgcaaaacactgcacctgggtgagaaaactagtatttaagtgtacaagaccatgaggtacaataatgtaggctccatgaagacagggatcatgtttttcttatcactatatttaataataattagcacagtgcttagaaacagtggatgctcaggtacttgatcaatttttctatttagttgaaggctgtctttcattcttagctagcttggttagaaggattcaccaaatgggaaaaggaacttcccacttttaagagcactgcggccgggtgcggtggctcatgcctgcaggcctgtattcccagcactttgggaggctgaggcaggcgcatcacctgaggtagggagtttgagaccagcctgaccaacatggagaaaccctgtctctactaaaaatacaaaattagctgggcgtggtggcgcatgcctgtaatcccagctactcaggaggctgaggcaggagaatcacttgaaccagggaggtggaggttgcagtgagccgagatcacgccattgcactccagcctgggcaacaagagcaaatctccgtttcgaaaaaaagaagaaaaaaaaaaagagcactgcatggtcttatcagtgatggaagcttgttaacacaagagagattgaaaagtgaagactaaatccagctccttcatatgctggcactgttctcacagggtaataatcattgagttaactttggtctacaaaggaaagaaatcccagacttcccttaccacatgtcccgtgtggggattcttatgggcatatggtggtcctcttatatggttccacatttgaccagatgtcatagcaagcacaaaacactaggaaacaaaaaaataataaaatattcatggtcaaactgttcttgtcttgattagataacaggaatatgaaaatgtgcatctgtttagttaagacatagaattttttgcagataaatgatttattaaggcttatatttcatcccaaggatcacaattcgataatacttcaaaaggaaaacactattttttttttttgacatggagtctcgctcttttgcccagactagagtgtagtggcgcgatctcggctcactgcaacctccgcctcccaggtttaagcaattctcctgcctcagcttcctgagtagctgggactatagaagcatggaaccacgcccagctaattttgtatttttagtagagacagggtttcaccatattggccaggttgatcttggtctcttgacctcgtcatctgcccacctcggcctcccaaagatatgggattataggtgtgagccactgcgcctggccaggaaaacactatttaaaaattataactatgcagacacaagtttcaaaattgaatactgaaaaggctttttagaataaaattttcaggctgggcatggtggctcatacctgtaaccccagcactttgggaggctgaggtgggcgggtcacctgaggtcaggagttcaagaccagcctggccaacatggtgaaaccccgtctctcctaaaaatacaaaaaaattagctgggcgtggtggcacacgcctgtaatcccagctactcgagaggctgaggcaggagaatcatttgagcccaggaagcagaggttgcagtgagccaagatggtgccactgcactccagtctgggtgacagaccaagactccgcctcaaagaaaaaaaaaaaagaat

SEQ ID NO: 665 - DNA, 8241 bp, Homo sapiens
taatgaccagatggtccttactctatgacttaaaccaaatttttgcctacaatgcaacacatgaggctagaacatgaactctctggttgtccgagaggggaaccaggtcaaagaccaccaggatttgtaaactgtttgccaaagatcttccccaagtttcaaataaatttttcctaattgtaccttcatccacccagtttatcacctgaaggagacaatttgatgccatggaacttgctggacctgtaacagtgtgaagtaaatcatacccagatagtctcagtgaggagtatatttaatttctgaaagaacaagattcgtgaggagcatgggtggtttaggcctcattttgttttcagatggaaagaaaatagcaaaaattcaacagtaagacaaggtcgtaccaaactggacaaatctcctggtggccatgatccgtggggcctttgtctctgggtagcattttttcagacagaaaaggcgggagaagaaagctcctagacagagcttccaagaaaatatgaagcactactgccaccgtgaggaaatagtttgaagacagaatccgccattacagtattcttccctggaagcctcgctgtgggggaaggtctaatctatgctgaggtggaagaggattgggctccaggctaggtcttgttgccttctcctctaaggtcttaagagaggcctggacattggcggtatcttggtgtagaacctggagagtgaggggcttggagtgaagcagcagctgccaggcagtcctggcacaggaatttccggggcagggcctctatttccccagttgtttgctggacaacaggaacccactcaaacacacatgcaggctcttgtgggcatctgtctcctgttcctgccccttggagcaagagttggcaggctttcatgtgcttgcatcttgctacaggtctttgggtctctggtagcatcagtaccgtgtacaaggaacaggattttaccaagcgacattcacagtatttactttccttcactctccaggttctataccaagacactaccaatgtccaggtctttttttttttttgacggagtctcactgtgttgcctaggctggagtgcaatggcgagatctcggctcactgcaacctccccctcccgggttcaagcgattctcagcttcctgagtagctgggattacaggcgcctgccaccacatccgactaatttttgtatttttagtagagatggggttttaccatgctggccaggctggtcctaaactcccgacctcagacgatccgcccgcctcagcctcccaaagtgtggtctttgaggatagggcaaggatgagcagcatggagctcaagcctcttccccctccccacaggccagaccttctccaacaggtggaaggactgtcttcaggggaaggacattgacatggcttaggcatagggcgtagggcgttgcttaactatgtcctaacggtggcagtagtgctctagatgtgctaacaggtgtcgtggagccttcttctcccgcccttcttgtctgaaaaaacgccacccaaagacaaaggcacaaggaaacatggctgccttgctttttgcccagtttggagtcatctggtcttactgtggcaattttgcttttgttttccatctgaaatcaaaccaaggccgaaaccacccaccctcatcagaaatcttatttgttcagacatttaaaatcctcctaacctagtctatatgattacgatttacctcagatttataggtccagtactttccatggcatcaaactgtctccctcgggggataaatttggggatgaaagcacagcgataaaattgcttgaggctccgagaccaccaggatttacaaatcctggtggtctctattctggctccccttccagacaaccagggagttcttcatgttttagctcatgtgttgcattgcagacaacaatttggcatgaaccatagaggagggaccagatagctgtcattactgcatgccatatgcgctccacatggcatgatactcatactacatatcttcagttcctatcaaggttattcacagtttcatctcatggtctcgtcatttaacatcaaaactcggcatgttcccatgacactacatagtcttcaagtatttcctgagactttatggggtgtgtctgtttgtgtgtgtgtgtgtgtgcatgtgtattttataatttgtcttttagatataagtcttacagtattctcccactagttaattaaagaataatgcttgacaaagattgagaaaaatcaatgtactaataaagatggaaagcactacaatacaatttgtctaggcaataaataaataaatttggattatttccatgcactcccaggcttattaggaagaggaaattcccgcctaataaaagaatatatttccatgcatatattcccgcctaataaattttggtcagactggttgatctcaaaaaccctgtctcctgataagatgttatcaatgacaatggtgcctgaaacttcattagcaattttaatttcccctcggtcctgtgatctctccctgcctccacttgccttgtgatattctactaccttgtaaagtacttgatgtctgtgacccacacctattcgcacactccctccccttttgaaaatccctaataaaaacttgctggtttttgcagcctgtggggcatctcagaacctaccgacatgtgatgtcttccccagaagcccagctttaaaatttctctcttttgtactctgtccctttatttctcaagctggccgacgcttaaggaaaatagaaaagaacctacgtgaatatcggggctggttccccgatatatacacatcattttttttcttttttgagactaaaactctctctgtctcccagcaggagtgaaatggcgagatctcggctcattgcaacctccagttcaagcgattctcctgcctcagcctcctgaatagctgggattacaagtgcatgccactaggcctggttacttggttttttttgtttgttggttttgtttttttttttttttgagacggagtctcgctctgtcacccaagctggagtgcagtgatgtgatctctgctcagtgcaacctccgtctcccaggttcaagtgattctcctccctcagccttctgagtagctgggactaaaagcatatgccacctgcccggctaatttttgtgtttttagtagagacagagtttcaccatgttagccagaatggtctccatctcccaacctcgtgatctgcccgcctaggcctcccaaagtgctgggattacaggcgtgagccacctggaccatccccaattgttttgtatttttagtagacacaggatttcaccatgttggccaggctgttctccaactcctcaccgcaagtgatccaatcaccctggcctcccaaagtgctgggattacaggtgtgagccaccacgcccggctatatatacattcctaatttcatgcaaataacaaatctgtattgaaattgggtcacactctacactgtggtttggagcagatcaagtgtgtattttaacaaagctttcaggaggatgaattcatttgaatatcataaatggtaaatgttttcaacattgcaagccttcagtgtaaatgaaggtaactctgaaaaatatatgctcagaaacattcctttagaaatgtagacaccattcattttttgtttaaatttttacagatgcatcacaacgtgcgtattggctctctagaatacatacatgactatatgtttggtttaaggttatgacatgttagaagtagagtaaaatgcactgggcgcggtggctcatgcctgtaatcccagcactttgagaggccgaggcgggcggatcatgaggtcaggagatcgagaccttcctggctaacacggtgaaacctcgtctctactaaaaatacaaaaaattagccagacgtggtggctggcgtctgtagtcccagctactcaggaggctgaggcaggagaatggtgtgaacccaggaagcagggcttgcagtgagccgagattgcgccactgcactccagcctgggtgaaagagcgagactccacctcaaaaaaaaaaaaaaaaaaaagagtagagtaaaatacactttactttgttatttattatttatcttatggtgtggtaggtttaatccacaaggttcaacaatttgctattctccctaaatcagaggcaaggaatggctgtttacgaggatacagagaatgcaattaagattttatgatggctaaagggactacctggtgcaaatgaatgacatgtatccaacctaaatgggaatgataggctcattgcccctccacactatcttccattgcagaataaaccaatcaacctccttgtcactaccactggtacttggctaggtgtgatttccttgccaggcttctatccactgcccaggcacacagcctctattaaagatagttagcaaggggtgaataaaagatcacttagcctaaagaattctaggtttggggacaccagcatttctaccttcagatatgagacactgtcccataggtaggtctgtattcttccatgaaaatggtcaggtcaaactattcctccataggaggtagtttagcagatgtctaagtctactttaggtgaaatactctggggaggtaagatatcaagggtcatggagaaatgcttcccagagagtctccaagacacttgtgcatgccaatagcatttatgtatgcagatcatcattcaactagacaaagtcaaagatgtcaaaaaagctaggttaccctagaatgccttaccctggaatgcctgcctgaatcctcagaggccaggagaggtcatacctgaacaagctcttgaagcactgtaatgtcacagtgcagaaccagactaacattaattcctttcattaagaattcagatactaaaataataaattctgaggaagaatgtcatgaggatcaagtcacccatacacttttagtcaccattttgattctcaattatgagtcataaagtatctagaggtctccacaccaaaggttggatatcttcattaggaaatagatttgaagctgctacagaaaatactagctaggatgcagtagataatgatttgctcaggcctaaacaatgccatacttaccaaggacatcgaacagaaaagagccacctatctgccctccttgagagaactgagatgacatcggcgtcctattatgacaaaagactttctcctgaacctataacgtcacagaagctgctggcttgtgcgctcagataattgcttaggccttccattgcatttttggccttcatcctctttagcatatcagctctcctaaaagatgatctggcccacataggcatctcagtgtatccttactgctctacagaggtccttctagctataggcaatggtggttagaattttagtgtattgaggaccatgtgagtgacgctgacttcagatagatggttcctggaattggcctgtcattgccagccaacactgctgctataaatgtcacagccccacaacacaaggacaaccaggttgcctaaagctcccaagggcatattcataacataaatgccccaagggtctgtacttggctgtatcattttctagccttgtccccactatgagaaaacaggccctgtcctctacttcctgtgccaaaacttcctggaagcagctggctcagtcctgctccctcactcagcagatacttcacggagactttgcatttgttcattgcttctgccaggcctcagagaaaaggataggaagatcaacttgtgtctcgggtctgttcagccttcactggcttttccttcaattgctagggctcacatggaggaaacgctcacggctttggatgctacgaaactgtttccgcacgatggcagtattgtacgggagaagccaactgactttgctctaggcgctattctcccgcccatcacatttcaaaaaaaggccaagaagagacaaagacaccagaaactagaactacttagcagtttgctcaatttgtgtaaacttattccactcttagcattttgcttttgttttccattggatattaaaccgaggtgtgatccactcaccctcatcaatcatctcctcttttcatgaactcagtatctgcacaaccaatcttctcatttatactcttcttcactcagtattatatctgctgtgttttcttacatcaaattgtcttatagtactggggcagacctcagggatccatgcctaaggaaacaacaaacaaacaaagaaatgttaacacctaaggtcttggagaagagcaaatctaggcaccaggccatgtggttcatttgtttttttttttgagacagagtcttgctctgttgcccaggctggagtgcagtggcgctatctcggctcactgtaagctccgcctcccgggttcacgccattctcctgcctcagcctcctgagtagcagggactacaggcgcccgccaccacgaccggctaattttttttttttttttttttttttttttttttttttttttagtagagacggggtttcaccgcattagccaggatggtctggatctcctgacctcctgatccgactgcctcggcctcccaaagtgctaggattacaggcgtgaaccaccgagcccggccaggccatgtggttcttgtcctgactccctacccaggttccctaggagttccatttcatgttctgatccaggcattgggccttatatgttgagtgggaggctgccatttagtggagctctaagataagggaccaggtagttctcaagcttgacagagacacagaacccgattcgaatggacacaaacacaggaatgactataaattttaatcagatggatcacaggattttgtctcatggtttcattatttaacgttggaacacaaacattttcctgtgtcattaaatggccatggcttaagactgccctataactttgctgtgtatatgtgttactgttttccagttaggattcagtcctatattttctcattagtaacaaaaaggtggaatttgcaaagaagtaaaaaaaaaaaacccatgtgctgatcaagagaaaagcagtctcataaaactgtatattaaacactgatacccttttccatatttattccatttttcaatacatagataaaaagttctatatatagtcaacacaatgaatttacatttaaattggatttagctatgcactgcattttagtatgaatattccatagtatgaatgaagattttcattctaaaatttgatttctgaccagtttttgacattgtcatataaaatttgcaatttctgaattttggacaataaaatatttgcaaagaactatgtgattggactagtcattaagaattaagatctcaccttgcttttttaatctataaaatctatttatacatacataaacacatatataaatatatatattttacatagttatgcctctgaaaattaggattttaaaattattcttgaatttttatctctaattcttaccttcaaattttatctttaaaatctcaaaagaaagaaaacaaaattcaataaatgataattgaaataggcacatctcatattcagtcacttagatgtgaaccccagtaaaactttaagatggatgtattcacaccactcacatgaagctataatgtttcattaatgtctctgtttatgtaactatgaattaaagatatgaatttattggtcaaaaatatcatattcaaatgcatgctcagtataacactgaccatgatataaaatatatggcattggccaggcgtggtggctcacaactctaatcctggcactcttggaggctgaggcaggaggatcacttgagcctgagagttcaagaccaatttagtaattagcaattttggcaatgtagcgagtccctgtctctaaaaaaaaaaaaaaaaaaaaaaaatagccaggcatggtgtcatgcacctgtagtcccagctactcaggaagtggaggtgaaaggatcacctgagtccagggaggttgaggctgcactgagccatgatcctgccactgcactccagtctgggcaacagagtctgatcctgtgtaaaaaaaacatatatatggtatttaaacatttgtatatgcatatgaacagatatgaatacacacagagtaccgcacacatttta

SEQ ID NO: 666 - DNA, 320990 bp, Homo sapiens
atgacacaaaaggctaaaccaaaggacaagaaaagactgtatgtgaaaaagaaagtatgggcagtgcatattccatcccaggcatgcattgtgaatttgtgaaaggaaaagtagagcttgcaggtggcatttcccatgactctcagtttttaagaggctttctgaaaattctcagcagagacaagctatgcacttcaattatgcaggttatgatcttcttttattactgctctttgttttgtttcattttctgttctcttcttcagaaatattaattgcacatttgttgcatctttgttattttccatatttaaatttttccccaggtttttttcagatctgttttcttttatatttcaactctatcatttttcaagccacccaggtggatttctatacaatgattatgattgtatgttcagcagtacctaacctcatttaacatacaatgattatgattgtatgttcagtagtacctaagctctcatttctattattcttattgtgcttttcatttctctaaaaaaaaatttattctttcctgttacatattgatatggtttggctgtgccttcacccaaatctcaacttgaattgggtctcccagaattcccacatcttgtagagggacccaggggcaggtaattgaataatgggggccagtctttcccgtgctattctcatgatagtgaataagtctcatgagattggatgggtttatcaggggggttccacttttgcttcttcctcatttttctcttgccaccaccatgtaaggagtgcctttcaccttccaccatgaatatgaggcctccctagccatgtggaactgtaagtccggttaaacctctttttcttcccagtctcaggtatgtctttatcagcagcatgaaaatgaaccaatacagtaaattggtaccagtagaatggggcattgctgaaaagatacccgaaaatgtggaagtgacttaggaactgggtaacaggcagaggtgagaacagtttggagggctcaaaacaagacaggaaaatgcgggaaaggttggaacctcctagagatttgttgaatggctttgacaaaaatgctgataattatatgaacaataaggtccaggctgaggtgatctcagagggagataaggaacttgttgggaagtggagcaaagttgactcttgttatgttttaacaaagagactggaaacattttgcccctgcccaaaggtttgtggaactttgaacttgagagagatgatttagggtatctggtagaagaaatttctaagcagaaaagcattcaagaggtgacttgggtactgggtaaaagcattccattttaaaaaggaaacagagcataaaaatttggaaaatttgcagcctgatgatgcagtacaaaagaagaacccatttttttgaggagaaattcaagcctgctgcacaaatttgcataagtagcaaggaacctaatgttaatccccaagaccatagggaaaatgtctccaagccatgtcagagaccttcacagcaagccctcccatcaaaggtccgaggcccaggaggaaaaagtggtttcgtgggcctagcccagggactacatgttgtgtgcagcctagggacttggtgccccaagtcccagccactccagccatggctgaaaggggccaatgtacagcttgggctgtggcttcagagggtggaagccccaagccttagcagcttccacatggtgttgagcctgcaggtgcaaagaagtcaagaattgaggtttgggaatctctgcctagattttagaagatgtatggaagcacctggatgcccaggcaaaagtttgctgcaggggcggggccctcatgaagaacctctgctaaggcagtctggaaaggaaatgtggggttggggccccccacaaagagtccctactggagcactgcctagtggagctgtgagaagagggccactgtcctccagaccccagaatggtagatccactaacagcttgcaccatacgcctggaaaagacggagacactcaatgccagcctgtgaaagcagctgggagggaggctgtaccctgcaaagccacaggggcagagctgcccaagaccatgggaacccacctcttgcatcagcgtgacctggatgtgagacctggagtcaaaggagataattttggagctttaaaatttgactctgctgctggattttggacttgcatgggccctgtaacccatttgttttggccaatttctcccatttggaatggctgtatttatctaatacctgtacccccattgtatctaggaagtaactagtttgcttttgattttacaggctcataggtggaagggacttgtctcagaggagactttggagtgtggacttttgggttaatactgaaatgagttaagactttgggggactgttgggaaggcatgattggttttgaaatgtgaggacatgagatttggaggggccaggggtggaatgatatggtctggctatgccctcacccaaatttcaactagaattgtatctcccagaattcccacaagttgtgggagggacccagagagaggtaattgaatcatggggccgatttttctcatgctattctaatgatagtgaataagtctcatgagatctgatgggtttatctgtggtttctgtttctgtttctgtttcttcctcatttttctcttgctgccaccatataagaagtgcattttgcctcccactacgattctgagccctctccagccatgtgcaactgtaagttcaaataaacctctttttcttcccagtcttaggtatgtctttatcagcagcatgaaaatgacctaatacatatgtctttctggagctctgctagtacacttgtcatttctggtgtcttgtctcttctttgaatttgtgtacatcatctttgaggtcctgtttcaggcatcccatattttctttaatttattccatttcagagaaagatctttgttcaatgttttctgatgctttgtggcgtattttttgatgtatatacttcaactacctctgacttgtcatgtttctttccttatttccactgctggttccttttttttagttgttactcatcttttcattgggattaatctttggttaagaacataccctaaggaaaggagctaggataataagcttagataactggaaacttgacttctgttttaagaaaactttgtaactttctgtactgggggtatgtatctgctctgaagaagcaaaaaatatccatatgccacatatcctacatggaatggtttcatattcatttctcttttattggcccaagattaaaagctacagagtagattacaaaaaaatgtaataaatatccaccacatccatcttctgttctgtggtcatttctgaatataaacccctttagattttttttttttgagatggtatctccctctgtcacctaggttggagtgcaatggcacgatgtcagctcactgcgacctctgcctcccaggttcaagtgattctcctgcctcagcctcctggtagctgggattacaggcgcttgtcacaacgcccagctaatttttgtatttttagtagagatgagcttcgccatgttggccaggctggtctcgagctcctgacctcaggtgatctgcctgcctcggcctcccaaagtgctgggataacaggtgtgagccaccgcacccaaccccattttagatcctgagcactgggtttctccaggatttcatggggtggaggaaagcaataattacattgccaggtgccctatccatttcctaagacttcaagatccttgtctgtttttactttcatcatgaacttcaacctggatatttttattttcccagattattcttaaattgtttggtctcctaatagttttcacttctgaaagctttattctctattcatctttgctactgtagtattattcttgcttttacagttattctgacatcttgatggtgtttgaaaaatatgatgaagtgtcatcaaggactcaattttccatcttaaatcaaaagagtgtccaatggatttatatattttctaaacaatttagttgattgacctatatgtggagacacagatagatattatttaataggcagggaaggtacattgatataacatgaatacttggctgtgtacaacttctcagagaagtaatgcatttacttttaaccacgaagttggtttctctattgtcagaaagaaagaacatcaaaacagccaagacacctgctgtggaaatgtctctttcattgatctctgaaatctctattttatgctgactttcataagaagtatctaatcttccatactcgttcacctgggaagctgggatgttaactgccaaaaacctgcattgcaaaaacaaacaaacaaacaaaaacaaagaaactgaagaacaagaagaagctccatgtggatcagcaagcaagggcagtgtgagtccctttctaggtgtacctcatgaatttgcaagaggaaatacaagccttgcagatggcatttcctttggccattagttttcagaaggctccctgcaaattctcagcagaggaaatagcaggaatgataagtctatttccaaagccctttccaacaaccttcagatttcccgcattcagattgcacttaaaaatatcaaacgacttgccagtcttttcagcagccttctaaatacgtttctgttcaaagaaataatgggagtgacaggctgagaagtcaggaggcactcgataaatgtttctatgaatgagcgagtgaagtgaatgaaagtatatgggcatgaacgaaaagcctacaaatgtgagtctaaatctgtaaatgatcaaaaaagtatttttcctgagagaattatctcatctcaatttggaaacactaatttctggcctcggagagtgcatataatctattttctcatccagtcgattcacatttataaaagtaggtttttcttccagacaaagcacactataggaaaaagaaaaaaaaactgataactgtgttatgccctctgtctgagccttcaaatctctttggttcaaatgggaaacttgtttctgctggctttcatccagtgttgcagcacttcaagaagtttcagctgcattagacttgctctcagcccattaaaacccataaaccctccaagatggccgaataggaacagctccagtctacagctcccagcatgagcaacgcagacgaggggtgatttctgcatttccaactgaggtaccgggttcatctcactggggagtgtcggaaagtggttgcaggacagtgggtgcagtgcagcaagcgtgagctgaagcacagcgaggcatcacctcacctgggaagtgcaaggggtcagggaattccctttcacagccaagcaaagctgtgacagatggcacctggaaaatcgggtcactcccaccctaatactgcacttttccaatggtcttagcaaacggcacaccaggagataatatcccatgcctggcttggagggttccacacccacagagcctcactcattgctagcacagcagtctgagatcaaactgcaaggtggcagcaaggctaggggaggaaagcccacaattgcccaggcttgagtaggtaaaaaaagcggcctggaagctcgaactgggtggagcccaccacagctccaggaggcctgcctgcctctgtagactcaacctctgggggcagggcatagccaaacaaaaggcagcagaaacctctgcagacttaaatgtccctgtctgacagctttgaagaaagtagtggttctcccagcacggagtttgagatgtgagaacagacagactgcctcctcaagtgggtcactgacccccgagtaacctatctgggaggcaccccccagtaggggcagactgacacatcacatggccgggtacccctctgagacgaaacctccagaggaacgatcagacagcaacatttgctcttcagcaatattcactgttctgcaccccccgctgctgatacccaggcaaacagcgtttggaatggacctccagcaaatgccaacagacctgcagctgagggtcctgactgttaaaaggaaaactaacaaacagaaaggacatccacaccaaaaccccatccgcacatcaccatcatcaaagaccgaaggtagataaaaccacaaagatggggacaaaaccgaaaagaaaaactgaaaattctaaaaatcagagcacctctcctcctccaaaggaacgcagctcctcaccagcaatggaacaaagctggacggagaatgactttgatgagttgagaggagaaggcttcagatgatcaaacttctctgagctaaaggaggaagttcaaatccatcacaaagaagttaaaaccattgaaaaaagattagacgaatggctaattagactaaccaatgcagagaagtccttaaaggatgtgatggagctgaaaaccatggcacgagaactacaggacaaatgcacaagcttcagtagccaattctatcaactggaagaaaggctatcagtgatggaagatcaaatgaatgacatgaagtgagaagagaagtttagagaaaaaagtaaaaagaaatgaacaaagcctccaagaaaaatgggacgatgtgaaaagaccaaatctacatctcattggtgtacctgaaagtgacggggagaatggaaccaagttggaaaacactctgcaggatattatcaaagagaacttccccaacctagaaaggcaggccaacattcaaattcaggaaatacacagaacgccacaaagatactcctcgagaagagcaactccaagaaacataactgtcagattcaccgaagttgaaatgaaggaaaaaatgttaagggcagccagagagaaaggtcgggttacccacaaagggaagcccatcagactaacaacagatctctcggcagaaactctacaagccagaagagagagggggccaatattcaacattcttagagaaaagaattttcaacccagaatttcatatccagccaaactaagcttcataagtgaaagagaaataaaatcttttacagacaagcaaatcctgagagattttgtcaccaccaggcctaccttacaagagctcctgaaggaagcactaaacatagaaaggaacaactggtaccagccactgcaaaaacacgccgagttgtaaagaacatcaatgctaggaagaaactgcaccaactaacgagcaaaataaccagctaacatcataatgacaggatcaaattcacacataacaatattaaccttaaatgtaaatgagctaaatgctccaattaaaagacacagactggcaaattggataaagagtcaagacccatcagtgtactgtattcaggagacccatctcacatgcagggacacacataggctaaaaataaagggatggaggaagatctaccaagcaaatggaaaacaaaaaaaggcaggggttgaaatcctactctccgataaaacagactttcaaccaacaaagatcaaaagagacaaagaaggccattatataatggtaaagggatcaattcaacaagaagagctaactatcctaaatatatatgcacccaatacaggagcacccagattcataaaggaagtccttagagatctacaaagagacttagactcccacacaataataatgggagaatttaacacacgactgtcaacattagacagatcaatgagacagaaagttaacaaggatatccaggaattgaattcagctctgcaccaagcagacctaatagacatctccagaaatctccaccccaaatcaacagaatatacattcttctcagcaccacatcgcacttattccaaaattgaccacatagttggaagtaaagcactcctcagcaaatgtaaaagaacagaaattataacaaagtgtctctcagaccacagtgcaatcaaactagaactcaggattaagaatctcactcaaaactgttcaactacatggaaactgaacaacctgctcctgaatgactactgggtacataatgaaatgaaggcagaaataaagatgttctttgaaaccagcgagaacaaagacacaacataccagaatctctgggacacatttaaagcagtgtgtagagggaaatttatagcactaaatgcccacaagagaaagcaggaaagatctaaaactgacaccctaacatcacaattaaaagaactagagaagcaagagcaaacacattcaaaagctagcagaaggcaagaaataacaaagatcagagcagaactgcaggagatagagacacaaagaacccttcaaaaaatcagtgaatccaggagctggttttttgaaaagatcaacaaaattgatagatcgctagcaagactaataaagaagaaaagagagaagaatcaaatagaggcaataaaaaatgataaaggagatatcaccaccaatcccacagaaacacaaactaccatcaaagaatactataaacacctctacaaaaataaactagaaaatctagaggaaatggataaattcctgaacacatacaccctcccaagactaaaccaggaagaagttgaatctctgaatagaccaataacaggatctgaaattgtggcaataatcaatagcttaccaaccaaaaaaagtccaggaccggatggattcacagccgaattctaccagaggtgcaaggaggagctggtaacattccttctgaaactattccaatcaatagaaaaagagggaatcctccctaactcattttatgaggccagcatcaacctgataccaaagcctggcagagacacaacaaaaaaagagaattttagaccaatatccctgatgaacatcgatgcaaaaatcctcaataaaatactggcaaaccgaatctggtagcatatcaaaaagcttatccaccatgatcaagtgggcttcatccctgagatgcaaggctggttcaccatatgcaaatcaataaacgtaatccagcatataaacggaaccaaagacaaaaaccacatgattatctcaacagatgcagaaaaggccctcagtaaaattcaacagcccttcatgctaaaaagtctcaataaattaggtattgatgggatgcatttaaaaataataagagctatttgtgacaaacccacggccaatatcatactgaatgggcaaaaactggaagcattccctttgaaaactggcacaagacagggatgccctctctcaccactcctattcaacatagcgttgtaagttctggccagggcaattaggcagaagaaagaaataaagagtattcaattaggaaaagaggaagtcaaattgtccctgtttgcagatgacatgattgtgtatctagaaaaccccatcatctcagcccacaatctccttaagctgataagcaacttcagcaaagtctcaggatacaaaatcaatgcacaaaaatcacaagcattcttatacaccaataacagacaaacagagagccaaatcatgagtgaactcccattcacaattgcttcaaagagaataaaatacctaggaacccaacttacaagggatgtgaaggacctcttcaaggagaactacaaaccactgctcagtgaaataaaagaggacacaaacaaatggaagaacattccatgctcatggataggaagaatcaacatcgtgaaaatcgccatactgcccaaggtaatttatagattcaatgccattcccatcaagctaccaatgactttcttcacagaattggaaaaaactaccttaaatttcatatggaaccaaaaaagtgcccacattgccaagtcaatcctaagtcaaaagaacaaagctggaggcatcaagctacctgacttcaaactatactgctagtctacagtaaccaaaacaccatggtactggtaccaaaacagagatacagaccaatggaacacaacagagccctcagaaataataccacacatctacaaccatctaatctttgacaaacctgagaaaaacaagaaatggggaaaggattccctatttaataaatggtgctgggaaaactggctagccatatatagaaagctgaaactggatcccttccttacatcttatacaaaaattaattcaagatggattaaagacttaattgttagacctaaaaccataaacaccctagaagaaaacctaggcattaccattcaggacataggcatgggcaacgacttcatgtctaaaacaccaaaagcaatggcaacaaaagccaaaactgacaaatgggatctaatgaaactaaagagcttctgcacagtaaaagaaactaccatcagagtgaacaggcaacctacagaatgggagaaaatttttgcaatctgctcatctgacaaagggctaatatccagaatctacaaagaactcaaacaaatttacaagaaaaaaacaaacaaccccatcaaaaagtgggcaaaggatatgaacagacacttcttaaaagaagacatttatgcagccaacagacacatgaaaaaatgctcatcatcactagcctttagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaacccttgtggaagacagtgtggcgattcctcagggatctagaactagaaataccatttgacccagccatcccattactgggtatatacccaaagggtcataaatcaagctgctataaagacacatgcacacgtatgtttattgcagcactactcacaatagcaaagacttggaaccaacccaaatgtccaacaatgatagactggattaagaaaatgtggcacatacacagcatggaatactatgcagccataaaaaatgatgagttcatgtcctttgtagggacatggatgaaactggaaaccatcattctcagcaaactatcgcaaggacaaaaaaccaaacactgcatgttctcactcataggtgggaattgaacaatgagaacacatggacacaggaagggaaacatcacacaccagggcctgttgtggggtggagggaggggggaaggatagcattaggagatatacctaatgtaaatgacgagttaatgggtgcagcacaccaacatggcacatgtatacatatgtaacaagcctgcacattgtgcacatgtaccctagaacttaaagtataatatatatatataaaagaatgcagccaaaaaaaatcccataaaccctagggagacttcagagggattcaaaataggaagaagtccttttaccaagaaacttgatagaagccaagatctacatcctcagacaaaaggtaagtctataatgatatggtttggatttctctcctcacccagatttcctgtcgaattgtaatccccaatgttggaggagggccttggtgggaggtgattggattatggaggcgaatttccccttttctttcatgagaacagcaagggggaatgctgagtgagtgagttctcatgagatctggtttttaaaaagtgtgtagcaactcccccttcgctctcttcctcctgctctgaccatgtaaagacgcgctggcttccccttcaccttccaccatgataccaaatttcctggggcctcctcagccatgcttcctgtatagactgcagaagcaggagccaattaaacctcttttctttacaaattacccagtttcaggtatttctttatagcagcatgagaactaactaatattaatacatatgccttccctaaattgcatagagattgattatttcacttcatgttggtaaagaatttatatagatattaaaacaacaacaatgacaagtgtctggacattaagtatattatttatttagaaaatccttgagggctattatgaatatctaaggatgctataaagaaaataaaaataatttacttcagtctctagtataggaactttcatgatttgctatgaaccatacccatactcctattatattctgaaatgaatgattcatggcattgatatggagaaaattttaataaatatacaaatgctcggtaaattgtgcaaggttatacaaatatgtgttgtcctgttgctggtattcttatacttagatgtcagtagtggaattaaagtaatctaaagaataattagaatccctttgactcaactcttctcacagattagctataacctaacattttttagggaaataatgtattaattactgatctcttgccttttaaaactttcagctcaaacagttttctggaagatttaccttaagtgtttcctctctttccaactggagtaatggtaactcagtgacaaaatgatggacagggtgactaagttccttggcccatctctatctgcaccttgggaatgatcatattgactcccccacttttttttcagtgattctgtcaagaaaactgtaagaaaaggtctccaacatcctaggaacagagagatataatcaatttaaggtattctacacataacccaatttgtccatactgccatcccccagtaagcatggagtatgatgaattgatgataatattcatgcaaatgtttgatcatgatagaattaattttgctctgatgtagcctggtccaaagtcactggagaaaatattgcagtgaaaaaactttacacatcaaaatgtttgtcaatgtccaacaaagggcttaatgatttcagcagtatttgacacaatattcttaacaaaattaggatttggcacagtccctaaagtttattataagaagattttaaaattatgttacttaaagtcccatgtgatgaaaaaaaatctttaaatgtgctcatccagcctatgcacaaataacaataatagaaatttcattaaaagccctgaatattcctttattgaaagcttagactcccttttatgagaaaattatcaacaaactaggaatagaatggcaattcctcaacctgataaagggaatctatgaaaaacccacagaaagcatcatacttactcatgaacaagtaaatgctttcctcctaattcaggaacaaaacaggaatgtccagccttgccagttctattcaacattgtactggagattctagacagggcaattaggcaataaaaagtaaaaggccaccagattggaaggaaatgggtaaaattttctctactttcaaatgacatagtcttatttatagaagatcctaaggaattcactgaaaaagagggaaaaaactattggaacaaataaacaaggttgcaggatacaagatcaatatacaaaattcacttgacctaagcaacatgaaaatgaagttaagaacaatattctattgacaatagcatcaaaaagaataagctgcttaggaataaaattcaaacaaaaattgccaaatttatactctgaaaatgataaaatactgttgaaataaattaaagagatctaaaaaaggtggaaaaacaccccatgttcatgtatcagaaaatttaatattgttaaaatggcaatattccccaaactaatttacgtatccaacacaactcctatcagaatcccaactttcttctttataaaaattgacaagctgatcctaaaatacatatggaatttcaagggacctggaatatctaaaacaattctagaaagaacaaagtaggaggattcatgcttgctgataagactcactacaaagcaatagtaattaagatggtgtattactgacacaaagataggcattatatatagctagaatagaattcaaagcccccaaataaactcttgtatctatggtcaactgatttttcaagggtgccaacaccactgaatgaggaaagaaaaatcttctcaaaaaatgatggtgggaaaactagatagccacatacaaaagaatgtagttgaaccctcacctcataacatatataaaaaggaactcaacatggatcagagacccaaaaataagaactaaaactacaaactcttggaagaaaacatgtggctacatattcatcatcttgggtttggcaaaagattctttgatatgacaagcaaaaatataaataagttgaaacttatcaaaattaaaaacctgttgtttcaaagtgaagactatttaaaaagtgtaaacacaacccacggaatgggagaaaatatttgcaaatcatatacttgataagaggctatgaatatgtatttcccttaaataattaagtaagctatagtaagtttaacctaaaaattagacctaatcctgagttctataggtttgctctgatttcattcagaccctgggtttaaaagaatcccatgaatatctcacaagtgcaggcaaccaaaacaaacatagagaaatgagattacatcaagttaaaaagctcctgcacagccatggaaacaatcgacaaagtgaggagacaacccacagaacgggagaaaatattttcaaactatccatttaacaagagataatgaccagaatatataaggtgctcaaacaactctacaggaaaaaaatataataatccaatgttaatatgggcaaaatatttgaacagatatttctcaaatgaagacatacaaatagcaaatgggcataagaaaaagtgctcaacataattgatcatcagagaaatgcaaatcaaaactacaatgaggtatctcactccagttaaaatggcttttatccaagtcaggcaacaacaaatgctggcgaggatatggagaaaagggaattcctgtacactgttggtgggaatgtaaattagtacaaccactctggagaacagtgtggcggttcctcagaaagactaaaaatagagctaccatatgatccagcaatcccactgctaggtatatacccaaaagaaaggaaataagtatatcaaagagatatctgcactcccgtgtttgttgcagcagctctgtttacaaaagccaagatttgcaagcaatctaagtatccatcaacagatgaatggataaagggagcactattcaaccatgaaaagaatgagatcctgtcatttgcaacaacatggatgaaagtggagatcgttatgttaagtgaaataagccaggcacggaaagacaaacatcacctgttctaacttatttgtgggagctaaaagttaaaacaattgaactcatggagatagagagtagaaggatggttaacagacactgggaagagtagtggggaacttgggagaaagtagggatagttaatgggtacataaggtagttaaaataaacaagacctagatttgatagcacaacagggtgactatagtcaaaaataatttaattgtacattttaaaataactaaaagagtataattgtttgtaacacaaaggataaatgcttgagggaatggataccccatttatcatgatgtaattattatgcattgcattcctatatcaaagtatttcatgtaactcataagtatatacacctactatgtatccacaaaattaaattttaaaaagataaaagaatcccatgaacttgtctatgtcttaatatctccaagcgtcttttggatttcacaaataatttggtcctgacagcacttatgtgcagtacctaaaacagattactattcactattgcacaaacagaaataggttaatagacttactaaagtcataggcaagtttgtgacagagccaagactagaacctacatctccctacaggccatttacatttttatattgaggtcatctgtgatagaattgtatttttaaatatgtgccattagattaacacatttgttgcaactcttgtgtcaaagacacaaaaagctttggaaactaaatcacattgcttggcttctgtttgcttagaacattttttttttcactgtttttaagtctttaaagttccttcactttcatcttaaggaagtgttctactttttccctactgtttacaattaatacatcattatggggctggaagtttcaggtgaagttaactgccaagtctgccaacttcttaacaatgcccaatgtgtcatctttgggggtttgcaagaaacagtttttaattgctcaactttgagcagtgcactaaagctaatcatgcccctagagcctggaagaatctctgagatacaaagctatcagaagtgttctgtttgtccagcaccaactaaaagcaaggcaggcaggaagaacattatttcaacttaacaggggaaacatcatttttcaatgttgagacaaatttttttaaaaatctgtttaaaggctgttaggagatgcttggctggttagtcctctccagcacctcatctcccattttttttttctgctaacccatagatcaggactacctcataatagaagggcagacttgtcacttgctactttaggattatgaatttgtgcataactccatacaggcactcaaagactatgacaaggaattgtttagagcacagttagacctttggaataaattgcacactctcttttttgctcaccctctaataatttttcaagagttcaccaaaagcacatttattgaaggagatcttctactagtcacagtctttccaaaccagtaaaatatattcccaccagctgggtccccaacttctgccactttccctttgcccacagtgcttcctcctattcagcatcctaaggccttaatttgactgttaggatacatccctgcactaagctgaagaattcattagtgtttccgttttcctcttactcagatctgctctagcaccttttagctaggtcctaacacaacttccttagttgtcttccatatacaaaaaagatatttatgatctgctttcaatagaaacaatttctctagaattacgaataaagtaattggaatgggcctcagagatagtctatacagcaaaagaaactgaagcccaaaaatttgaagtgactttcccaaagccagacagtttgtgaagagttcatgctctccttacgtcctcccttctggcaaatatgagaaatgacatattagagatgcatttagtgaccatgaggctgactgaagctaagctattctcataggaaccaatcctatatcttaaatattactgtgttatgattggcagtgaaacaagccttagctaaagacagatgtcttaatgtggtacccatatcatgtcactttgagttatccaaggacctgaacaaaatcttgctgagtacaaaatctgagaaatttgtcctcaaagcaagtatcaagcaaaagaccatatgtataatttcccaaaaggcactggtctggaagtaagaaaatgagttttctatccatctctgtttctaattaattatgtgacatttggccaactcacttgattgctttaggcttcagttttctcagctataaaaactgtaggtactaatttatgtgaatgcattgggaaaagtaaaaatagctaacatgctaatatttattgagatttaccatgtgccaggcactgtcctgggcattttatatgtatttcctcacttcataaacaaggaaaattaggcccagattattcagattacctaaaaaaaactccacagagttagtaagtccctgagtacacaaccttagccattaccccagactgcctctccttaccctatattgtgtctactgccactaccactaaaagtgttaaaaaggccaggcatggtgtctcacacctgtaatcccagtgctttaggaggctaaagcaggaggatcgcttgagaccaggagttcaagaccagcctgggtaacacagtgaaacccaagctctacaaaaaaaataaaataaaataattaattagccaggtgtggtggtgcgtgcctatagtcctagctacttgggaggctaaggcaggaggatcccttgagcccaggaatttgaagttgcagtgagctatgatcatgccactgcacactagcttgagcaatagagcaagacactgtctctaaaattaaaaaaaaaaaagagttgaagaagtataaaaacaattatctgtgcgcagattacttatgatatagtttaaggttcgggtaacattgaaacacaaaagaaccaaagaattaagctgagccttgaaagacagattgggtaagctttagctttacaaattagtagaacattagaagcactggtgcaaaagaagtgggagtgagcatgggggtactcatggagcaatgaagaaactaacctgactcaagtagagagattgtattgaggagccatggagacaggggcgaacatgggaatcaataaaaccctttatcaccatatagtttgcttacatagcacttatcacaggtgcatatttgtattttttttttaatttttgtgtttgtacatagtagttgtatatatttatggggtacatgagatactttgatataggcatgaaatgcataataatcacatcatgggaaatgggatatccatctcctcaagcatttatcctttgtattacaaacaattcaatatattctttcagttacttttaaaggtacaattaaattatttcgattatagtgtgctagcaaatactaggttttaataatcacatcatagagaatggcataggatatattcttgattgttagttaatgttaatatcaatttcccccaaaaacagtaagcttcctgaaggtaagaaccactttattcagcataacactggaagtcctagctagagcaatcagacaagagaaagaaataaagggcattcaaatttgaagagaagacgaatggtttgttgttgttgttgttgttgttgttgttgttgttttgcaccattgtatcctcagtgccaaatacattgccagacacattgtaggtgctcattaaatacttgttgaataaatgtattcatgtgtgaatgaatgaatgttaaataatagatgaggaattgtcatacttgaccttgcatgtcagatgaggaaatatagccttgacagagactttgatcaggctggggtgctggaagtggaactgaaaagccaaacataaaggctgttttaacatggggatcaataacacagttgctctctgttgtgcactctctataccagctgtcccctgatagacatttctctaccagttgcaggctctgtcatgacatcagtttcatacagaaagaatgtgaagaaactgtaggccaaaataaaaaaagaattatttcttagttctctggaaaggccagtagtggtatacaaaagtcccacagtctcaaaggtctcctttctcttttctttacttgttttccctacacaaaatgccactttgtgttttgttttgtttttcaaacagctctgatttggcaaaacttcattgcctgtttgggatgaggtccctgaagctctcagaagataattatttctttctggtaaagatcagaaactttgaactctacttgtgagataaatggtctggtggcactttgaaacttcaacttatttaagttactgagcagctcatcaacttacttcctgcatttggaattgaatctgaaagagaattagaccccagacatcttgagtaggccaagtaggtacaatttatagattttgttcagagccaaacatgctcccagagatagaggcctggtgacagcttccagataaacatatagattgatggaatctacaaaccaaactgctcaatgaaaggcaggttctggtcagttatattttctaggtaaatgaggggtatccagacattttttgtttcaactccattataatgcttttgaaatgctggagtctattctccagccttagtgggcaggtagagtgactgatattcgatctttttgctgattgagggatgcacaggaccttgtgggtatgaaattatacatttttactactgagcactgagaagaggttgtggagaaagagtaggaaactggtagggtatgtacagagcccaggacctttcctaggcatcatccaatttagtttaaagccctgggtgcagaatgttttgttattgttttcctttttttaagaaagtgacaatttggtttagttggattccatttcaccaagataagataatacatagataaatattgccaagaggcaatggatgtctaaactagaaggttgcaaattgaaataacctaagggtcttgatgcagagcattcaaatgacctcaatcctgtatatgtcataacttttctagggaagattgaataaggttgtatgtaggtcaaatgccattgaaagaaatgtttgtctaagacattaaataatttaattagataccattaccaagggctgcagatcaaagggtttgttgattgagatttgacctaatctaaaagaattttctttcttcaggggtttctaggcatttgtgagtttgagaagctgggaaggcttttgaaatattgccaggaagtttgcagggagatcgtcacagtgctaaacctggcaactcttggagaattgttcttttgggcagcccattctgttccatctactgatacttgagagggacctccactggtgagtaggtaacagaacaggttttaatttattttcttttctcctttcctcctcttcttgggtctttaaccatctatctgggatggacaatctccaggaagacaagaggcagccattagttaaaaggaaagttatgctatatcaataaataattgcaggtaacaggactaagatgggaaacatgctgggttcagtttgccagaaatttttaatggtaattctaggatgaggcaatcagcactgtctctggaggccagggcctagactaaatgaaaaatagcccccccaatttagatgctgagtagcctttaagtgtgagagggaaattgtcatcaattttagttctatgggtccaaacatggtactaatgggggcaaggtcatgagttcaaccccaatctctatcagcaagtttaaccccatttaaaaaataagtcgatctcacagccatagactgatcaccaatttttagtcaaatggctcatcaatttattctactgggctcatgagggactgagggatagaaactttataaaccctccttcaatactggaaaaacaaaatacatcctgtggctcactgggaatgatagattcatataaggaggaaaaacgtctattttatcaatatttaatatttgacagcaaaagcagtgtgttttatagagttctaggaggaacatatagttttaaatggcataataatcagccatccacttcaatgcaaaatcagttcactctcccatctgtggccggcccattatctcattaaatattccactgtgaaagacccatatgtagataattgggagctaaatatactcccaaatattcaaaaaaaatttaagatatgactataccaacttaaatataagaggctgcgggtcattgtttcatgtagccatttgactcatatatttgtatgttctcactctgtagagatgattttctctattttcacttggaaaggtggaggcaggccaaggcaaaatctctttctcggggtcctatgataaatgaagacagcggcagcgttaggtctctcaagctctgagggcactcctgtgaagccaggtcaccaccaccctctccatcccttacatttgtttccctcttcacaaatagcaaacactttcctggatatatggatttacctttgttgtgcacctagcctatctgataggctgaaaaaggtagacaatgtgacacagggatagcttactagaaggccatgacatggaagggaaacgttaggaaattttctttcttaaagacttttaagggccaggagccgtgtcttacgcctgtaatcccagcactttgggaggctgaggcgggcggatcacctgaggtcaggagtttgagaccagcctggccaacatggtgaaatcccgtctctactaaaaatacaaaaattagctgggcatggtgtcgggcacctgtaatcccagctgcttgggaggctgaggcaggagaatcactggaacccaggagacggaggttgcagtgagccaagactgcgccactgcactccagcctgggtgacagagtgagaatctatctaaaaaaaaaaaaaaaaaaagatactttttaggacaagacaagtgagagagtttcccatttcagagatgattagggatacttcatttcttagaaaaccgcttctgtagcctacatgtctctccaacaaaggagaaaaatgtaacacatttcaatactctgcggagtgagttctttttttctttatctgagggaagtcgagaatcctagcttgttaaaactagacgggaccttagagataatttagtttaacaagattggaaataaaaattcaggcacgtaaggggaagaaacttgtctagagacatagcaagtgagtagcggaagctgcaaggaggggattagaaagaaaatgggagttagtctcatggagaaacacatatacatcaaaggggtgcttagcatagaaacagtaatgtcaagggaagaggcagatggaaaaagagaggttgcctttcaataaggaacagcaaaagaactccattcacacattccttcagcaaataattattgagctcctatctaggtactattctatattttgggcacacagcaatgaagaaaacagaaaaaccctgacctcactgagcatacattctagttgatagagacaagcaataaacataattaatagataagctatacagtatgctagatgtagttctaaggagaaaataatgcaggaaagggggatataaaatttcaatggctagaaatgaactcccagacgaggtgacccagaaaggatgtaatgcaatttcaggggctggagatgaattcctagatgacgtgacccaggaaggatacactgaaaagatgccttgtaagtaaaaacctgagggaattgagaaggtgagctgtgcaaggatctgggtttcataaatatggagcagaaagtttttacaaatatagaacagcaggatcaaaggctctgtgaaagggatgggctttgagtatttgaggaatggtgaggaggctagtgtgactggagcaaagtgagcaagggaaagggtggtaggagatgcgttcagagaggaggtgattgggaggcaaaccatatagggcctcgtaggtcatagtaaggagattggtgtttagagaggctgaaatgagaatctatagttaacaatatgatactgtatacttaaaattttattaagagagtaggtcttatgttaagtgttcttattacaaagataaaagagagaaggaggaaacttttagggatgtttgttatatttacggcattatttatggtggccgtttcatgagtatatacttatcttcaaactcaagatgtatacataaaatatgtgtacctttttgtatatcagtcatacctcaataaaaatagaataaattttttaatggaagagtgacctgatttcacttacagttcaactgaatcatctgaactggatgggaagaagactagaaacaggaaaaccaatgacgaagttactggaaaaatccaggtgaatgatgatgatgccttggaataaagaatggcagtgcaggtggcaagaggagtaggtagattctgaataacagctctgaatgcttaggactttatatattcatttactacctattgggttcttgtgatcccccaggtactgttctatgttctaggaatacaccagtaaacagcagacaagggccctgttattaaattcacatttgagtgaaagacaaataataagcaagtaatcaaattattaatataacttcaggtattagaatgtgttataaaaaatgaagcagggctaggggaaagagatgggtgaggatgggataagagagccttttcagtgaggctacgtactcagaccctctccttaccacccacacttttagaaacttcatgttcagttttcatactcctaactggggctcaacgacaacagaatagaaaatgtaggagaagctagaaatgtaacttcagcaggggatattagaagagggtcctcccagacctcactactacatctacataatatcagctcaggtcaaagagctaccttgcacccactctatgtcaggcaccgtggtaaattctggaactatggaaaaatgaaggcatgcacaatctaggagtgagagacatcccaaacatagacaatattttagctaagacatgtgtcagaaggtaccctgttggttgagattaataactcaagctaactgagattcaaccatgtctacatatcagatttatcttggaaaatgacgtgagaaagtcaggaagatggcctacctttcctgtcttcttagttaggaaaaattattcaagaagacctctagtggaggagggctggagaaattttcatataactattttcaaaaagataaggaactttccattttcttaggattgagggaggatatctagctttgcctctgttcccattatagatatctattccatttgtgtcccattcttctgaaaaggacaaagataatgatcctgcacaccctaattctttccacctttctcacaccctccatctttattcccattctttcaggtaacactaagtagccaattggcatccatttaatgaatagtggcaagagggaaagatggccatggacaatgtcacagcagtgtttcagtttctccttattggcatttctaactatcctcaatggagagacacgtttttcacattagtgctgataatttacctcagcacattgttggggaatggatttatgatctttcttattcactttgaccccaacctccacactccaatctacttcttccttagtaacctgtctttcttagacctttgttatggaacagcttccatgccccaggctttggtgcattgtttctctacccatccctacctctcttatccccgatgtttggctcaaacgagtgtctccttggctttggccacagcagagtgcctcctactggctgccatggcctatgaccgtgtggttgctatcagcaatcccctgcgttattcagtggttatgaatggcccagtatgtgtctgcttggttgctacctcatgggggacatcacttgtgctcactgccatgctcatcctatccctgaggcttcacttctgtggggctaatgtcatcaaccattttgcctgtgagattctctccctcattaagctgacctgttctgataccagcctcaatgaatttatgatcctcatcaccagtatcttcaccctgctgctaccatttgggtttgttctcctctcctacatacgaattgctatggctatcataaggattcgctcactccagggcaggctcaaggcctttaccacatgtggctctcacctgaccgtggtgacaatcttctatgggtcagccatctccatgtatatgaaaactcagtccaagtcctaccctgaccaggacaagtttatctcagtgttttatggagctttgacacccatgttgaaccccctgatatatagcctgagaaaaaaagatgttaaacgggcaataaggaaagttatgttgaaaaggacatgagccttctttgcttctaaacgtctaaaataacacaacgtccctgatggagaaaatggtttaaaggatctgactttatctttggaagtgattgacatatgagaagcttcaggaagtgctcccaccccaaatattattcctactgagacttgaattgccattagaggtattatttttgctctttctttacatagaatattgttagtggctacccattaggttactcaccttcaggtaaatgaacttatcagagtaattttctcactgacagaagagacctatacagcaagagaatcttctgtaactgttgacagcaggtgaggcataactgaaattggaaactaagacaaagaatggtataataaaaggccagaagacaaatgtcagaaactttacaactttactgagggtaagccctgttacgtaagcacaatctccttgtttcacttaatcttggaatcatgagaaaaattatcatagctatttcctacatttgtgtagagtgttttatttttgctttttgtttttcaaaacatctttctaatctattagtctattttatatccctaattttcctatggaattggtaaaaacaccaccacaatttccctctgtattaacaatgaggaaacagagtagacattgagactcatctaaagtcatacataattgataatggagtcaaaattagaatttagatcatatatatgccacctccgaatttgtaaaagtaagtctgtaaaattatttagaatcatagaattataaatacagctaccatttattgagaacttatgatacgctaggggttgagcaaagctctctatatctattatcacatagaattcacacagtggttcaatgccatggcactattttccatccatatttagaagtgtggaaactgagtgatttgcccatggccacagagccagtacttaaatctaggtctggttgattccagatcccacttactatatctaaaggcataagaaaccctagagatgactaatgtagtgatattttaatccactttatcatgacataatttgtatacaataaactttgtccaattacagtgtgcaattctatgagttttgacagatgctcacagcatcaccacaacaatcagctacctaacaatttcatcacctacagaagtttccttttgccttcttgtaacccatcccttcctccctctacccccaattccaaccagtgatctgatttctttcactatatgttagtttttgtttttttaaatattgactataaataaaatcatgcagtctgtactcctttgtgtctgggttctctcactcagcctgctcttgagattcatctatattgttgcatgtatccgtaatttgttcctttttattgctgaataatatttcattgcacacatttaccgcatcttaaaacccattttctgttgatggacataatgcaatgtttttcaaatcttgatttatatagtttttagggactcaattgtggtgcctggagcctgctaatggggggtcgtttcctgtgagctatttcatttgaaaagggagttctaaaactaaaaggaacggttttgataaacaatgatctattacaggtaaccgattttagatgagaaatctaaggctcactgaatgtggagtaaatttcccaagatcatgaaactgtttggaagcagatctagaacgaagacccagatatcctgtctcctggtctcactttactttgggcctccaccacatatgatgaagtcatctcccaagaagccttttctacctgtttgtgaggaaccagacacaaacaggtagaaaaaaataaaatgcacagtacccagcactactgagcaaacagatactcagtgtgttcctcttactgtgactgctggggggctgaagagacattgtatggtgttgcaaagggagtaccatggatacaaggagactgtcttacgtgtttactaactaaatgaaaaataattgaggatgaataaactacttatcaaaacagcttaatttcaaaacaagtgcaagatttattcaaaccgtatactttttttttaattattatactttaagttttagggtacatgtgcacaatgtgcaggttagttacatatgtatacatgtaccatgctggtgtgctgcacccattaactcgtcatttagcattaggtatatctcctaatgctatccctcccccctccccccaccccacaacagtccccacagtgtgatgttccccttcctgtgtccatgtgttctcattgttcaattcccacctatgagtgagaacatgcggtgtttggttttttgtccttgtgatagtttactgagaatgatttccaatttcatccatgtccctacaaaggacatgaactcatcattttttatggctgcatagtattccatggtgtgtaagtgccacattttcttaatccagtctatcattgttggacttttggattggttccaagtctttgctattgtgaatagtgctacaataaacatatgtgtgcatgtgtctgtatacatttttaaaggtacatggtactcttcatctctgaaataatgttttaatattgagaaagaaaaaaattcagaaaaaggcaaatgaattcaatctttaatttatccatttaacaaacattaggtttgtactttaaggcaggcactatgctaggtattagggtaagtctcatgctttgtgcaaaatgttccttactatcaagataaacctttcaagcaaacattgtgaaataaacataaactggcacaatcaatgaaatattaaaagaatcaaagagtgtcttcgcacagaggaaaattcagaaattaggtggaatattaagagtataggttttaatgattctgcctttggagggaaaaatatttcactctctattacaggttggtttacagcttaaaatgggatgcacattttcaataatggtccctctactacaaaatagtatagctatgtcactaggttctttctccctttattgacttgttggtatgggcacagcctacagacagagtgacatagtggagtctggagatgaaggttgtggaattgattctgctactaacaagctgtgtaaccttagttatatctctctctggcctttaaacttgcttatcaatataacaggaagattgtgtttagctacctaaagacctctctagttctaacattctgcatccgggtgttattttatatagggcttgctcttattttcttaaaaaatgcaagcatatcatcaatttactctgcaacttgctttttccacttgacaatatatcatgaacattcctccagatcaatatatatagatctatctctctgactttaaatgttagctttgactgaaaaagaaggcaaacacggcagctagttaacacagctctggcccttccagcattaacattcagtttctaggcactaactctagaggctatctaattttacattgatattaatttattttaaagataaaaatgaactctgtgagggtgttgtgaaatgaaatcaatgctgggcttttgaaaattcctgagattgagtagtgcttctctgcctgatcaatcacaaggatcctgtgaaaccttccactggactcctccctactccccatccccaatggctgagtagtgaagcttaccttgcttcaccctggaaagaaagatggaaagactgtgttgaaactaagatggttctgtcaaaagttgagaagaaagtttacaaactgaaaagcaggctccaaatgatcatttccatggaaatattcatggagatttcagaaaaagatacagtgccccatttataggatttgggttttcagttgaagagaggcagtggagtataactacttagagcacaagccctggggcaaaacttgttagattcagtccttccttctgccacttcttcactcaagttaccccctgcttaggtctcttcacctgtaaagtgtagcactcagttcgatcaggcaaacagaaactactctatagttatttcaggaaggcatttaacacagagaattaggggcctacaaagcctttggaagggctatgagagaaaaggtaagggaactaccagcaaaatgagacagttgtaggaattgcaggaatcatgggaaattttagagattgttaggaaactgctgctaatgacgtcactgaagcagatgtttcacaagagaatgctcagaaatcacttaaatcttttctgatcaagcccacacacctaaacaagacgtcaggaagagcagtgatggtgtctacttcccttctgcttgccaagtttcctgcaagtacctctcatgggtggaatccaaaactgaacttgactgacaaatgagtgtgggaaatgtagcttccaagcttaacaatataggtgagagctagaaaaagcagggatatgacttaacaatacaggtgagagctagaaaaagcagggatatgaatatgacttcataggttggttataagaatatatatatgattcaatttatgtaaaataaaacacttagaacaatgttagctgtcacgatggtgtccagattatctgcacctaagatgccaggaattgaagtgcctacttgctttttaaatagtgcatcctgaggctgctccttcaattgtccattcaagcattcatacatatagcatccactgaatacatatttatcagctgtctaccagatagtgggtactaagctcatcactagggatgcagtggtgaaggaaggatacttgttcccttccctcaaagagttcacctcaaaggtagagagacaaacatgtacacaggcaacattattttgtaaagctatatcttcctaattctcatgttggtaaagtgctttacaaactttacagtttattttattcttgaacacgtattacctcctatcctcaaaataatttaatgagataagcagatcagatgttgctataaatattattaatgtcatttacagatgacaaaaaatttagagaggcaataatattatcaaggtcaacagttagtaacaggattggggttggaatacaattctcctaatacctagattaatgatctttctgatgagagcctgatgcgttcatggagtccttggaagaggggtaggaagaaggcaagattgttgctgagcagagagaggaagacactgtaggttcagattgtctaggttcaaaatagctaggttctgacacttactagctatacgaccttgggcagctttctgcctcagtttcctcatctataacaggaagacaattataggactgacccttgtagggttcttaagaagattaaatcagttaatttatctaaaatgctgagaactgtggcttggccatggtaagccctcaataaacgttaactatttttatcattattactgaagttgttgttattattgaattcccaattgacgtaaaagtagttgacccccatctcactgatcaccttctccctctcctctttttctccactagtaatgtgcatagtaactgtttctggttaagtgtgaacagcaggtcaaacacttttacagtgcaacatcatgagagactgggaaaaaaacatgctcaggcgtcaggaagtctggattctagtctgggttctgccattagtgagctatggaactctgagtgtatcacttaacctctctggactgcatctgtcatacaggggaaaatatattccttagcctacctcacagaatggttgaaagatcaaatgagatcatagatgttagatgttaaaaagttaaaagcacattacaaatgctgcatgatggtattatcattatcctcagagttaatctctccatctccttctcacttacccttgacaaccactcactcactgaattttattgagtcttgttctgaaatatttccccaacccaacccctcttctctgtcctcaatgcgtctgtcctagttcactgctttatcaatgcttatcaggatgactgtaacacactcctaactatttttctctagcccagtattacttccttctaaactagccatccaatcactgtctccagagtgatttttctaaagggaaaatctcatcaatctcatcttgtcacttcaccccctctataatctcactcccagattagaaatttacagtggctccctattgcctacaggatatgtggcattaatgaagcctctgctagtctctccatcctcattatccacctcatcaccacagaccccacgctccaggaagacaatactttctttccctgaaccttttatgtagcagtgctgctatacacactgttctctctgcctgcagaaccctctccactttctatgcctgggaaaatctcagtcccccttcaagaacaaaatcaaatgtcatttcctcagtgaagccctcctcaaagctcattccaccttgtttaagcctaggtacattacgtaattccatttcctttgcttaatagcattttgcttgactcgcaatttgatacatttcgtgctgttttataataatgcttgttttggagtgtttatccttaattagatcataagcttactgagagcaggaattttgttttgttcatctctgtctccttagcatagttcctggcacagagtgcatgcataataagaattaattaaatgtaagtgctcacaaatgttgctcaaactatttgtggtaaaggacagttttttaaaaaatttccaagctgttgcaggctgatatttgataaaatatgataaacatgtcacagcaatatcaaatcactttgatagttactaaatgttcactctcaattgtgtccttatctcactgcaaacattttgagtagcactcaggtagactttttgcaaagatgccttgcttctgccccctaaaatctggataactaatttgggaattttaacaagcatacacataaaaataataaacaagtgtatcatatattcagagcacaaactgggcaagaaatcaataaataaaactattgtaattagatatatgtatagatgtaataaattaaccgggcagtgaatgaaagggtgcaggattatatttagacagcaacagtttgcatggtacctcaaaactaatctaggaaagctttaggaaaaattgggatttccagaacctactcaaatcaaagatggctgagatggagtgggggaagttggggaaaagtggagagaaagaggagacctccagtaaacactgtttgcagaattttatttacctaaatgcttaattgaaagttttcatagagtctcaatagatagtggccactacacccaccccattcatttattaccttctttttaattattatttcacttcatgttctaggatacatgtgcagaatgtgcaggtttgttacataggtatacatgtgccatggtggtttgctgcacctatcaaccagtcatctaggttttaagccccacatgcattaggtatttgtcctaatgctctccctccacttgctgcccaccccccgacaggccccggtatatgttgttcccttccctgtgtccatgtgttctcatcgttcaactcccacttatgagtgagaacatgtggtgtttggttttctgtttctgtgttagtttgttgagaacactcattaccttcttgagccatgttgagaatgctctcaagaaacaggggactgggctggagccaagatggccgaataggaacagctctggtctacagctcccagtgtgagcgacgcagaagacgggtgatttctgcatttccatctgaggtaccgggtgcatctcactagggagtgccagacagtgggtgcaggacagtgggtgcagcgcaccgtccatgagccgaagcagggcgaggcattgcctcactcaggaagtggaaggggtcagggagttccctttcctagtcaaagaaagaggtgacagatggcacctggaaaatcgggtcactcccaccccaatactgcgcttttccgacgggcttaaaaaatggtgcaccaggagattatatcccgcacatggcttggagggtcctacgcccacggagtctcgctgattgctagcacagcagtctgagatcaaactgcaaggcggcagcgaggctgggggaggggtgcccgccattgcccaggcttgcttcggtaaacaaagcagctgggaagctcgaactgggtggagcccaccacagctcaaggaggcctgcctgcctctgtaggctccacctctgggggcagggcacagacaaacaaaaagagagcagtaacctctgcagacttaaatgtccccgtctgacagctttgaagagagcaatggttctcccagcatgcagctggagatctgagaaggggcagactgcctcctcaagtgggtccctgacccctgacccctgagcagcctaactaggaggcaccccccagtaggggcagactaacacctcacacggccgggtactcctgagacaaaacttccagaggaatgatcagacagcagcattcgcggttcatgaaaatccactgttctacagccaccgctgctggtacccaggcaaacagggtctggaggggacctctagcaaactccaacagacctgcagctgagggtcctgtctgttagaaggaaaactaacaaacagaaaggacatccacaccaaaagcccatctgtacatcaccatcatcaaagaccaaaagtagataaaaccactaagatggggaaaaaacagaaactctagaaaaactggaaactctaaaaagcagagcgcctctcctcctccaaaggaacgcagttcctcaccagcaacggaacaaagctggacggagaatgactttgacgagctgagagaagaaggcttcagacgatcaaattactccgagctacgggaggacattcaaaccaaaggcaaagaagttgaaaactttgaaaaaaacttagaagaatgtacaactagaataaccaatacagagaagtgcttaaaggagctgatggagctgaaaaccaaggctcgagaactacgtgaagaatgcagaagcctcaggagccaatgcgatcaactggaagaaacggtaccagtgatggaagatcaaatgaatgaaacgaagcgagaagggaagtttagagaaaatagaataaaaagaaatgagcaaagcctccaagaaatatgggactatgtgaaaagaccaaatctacgtctgattggtgtacctgaaagtgacagggagaatggaaccaagttggaaaacactctgcaagatattatccaggagaacttccccaatctagcaaggcaggccaacattcagattcaggaaatacacagaatgccacaaagatactccttgagaagagcaactccaagacacataactgtcagattcaccaaagttgaaatgaaggaaaaaacgttaagggcagccagagagaaaggttgggttacccacaaagggaagcccatcagactaacagcagatctcttggcagaaactctacaagccagaagagagtgggggccaatattcaacattcttaaacaaaagaattttcaacccagaatttcatatccagccaaactaagcttcataagtgaaggagaaataaaatacttaacagacaagcaaatgctgagagattttgtcaccaccaggcctgccctaaaagagctcctgaaggaagcactaaacatggaaagaaacaaccggtaccagccactgcaaaatcatgccaaattgtaaagaccatcaagactaggaagaaactgcatcaactaacgagcaaaatcaccagctaacatcataatgacaggatcaaattcacacataacaatattaacttaaatgtaaatggactaaatgctcctattaaaagaaacagactggcaaattggatgaagagtcaagacgatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattattaatgggggactttaacaccccactgtcaacattagacagatcaacaagacagaaagtcaacaaggatacccaggaattgaactcagctctgcaccaagcggacctaatagacatctagagaactctccaccccaaatcaacagaatatacatttttttcagcaccacaccacacctattccaaaattgaccatatagttggaagtaaagttctcctcagcaaatgtaaaagatcagaaattataacaaactgtctctcagaccacagtgcaatcaaactagaactcaggattaagaaactccctcaaaaccactcaactacatggaaactgaacaacctgctcctgaatgactgctgggtacataatgaaatgaaggtagaaataaagatgttctttgaaaccaacgagaaaaaagacacaacataccagaatctctgggacacattcaaagcagtgtgtagagggaaatttatagcactaaatacccacaagagaaagcaggaaagatccaaaattgacaccctaacatcacaattaaaagaactagaaaaacaagagcaaacacattcaaaagctagcagaacacaagaaataactaaaatcagagcagaactgaaggaaatagagaccaaaaaaacccttcaaaaaatcaatgaatccaggagctggttttttgaaaggatcaagaaaattgatagactgctagcaagactaataaagaagaaaagagaaaagaatcaaatagacacaataaaaaatgataaaggggatatcaccaccaatcccaagaaatacaaactaccatcagagaatactacaaacacctctacgcaaataaactagaaaatctagaagaaatggataaattcctcgacacatacaccctcccaagactgaaccaggaagaagttgactctctgaatagaccaataacgggagttgaaattgtggcaataatcaatagcttaccaaccaaaaagagtccaggaccagatggattcacagccgaattctaccagaggtacaaggaggaactggtatcattccttctgaaactattccaatcaatagaaaaagagggaatcctccctaactcattttctgaggccaggatcatcctgataccaaagccgggcagagacacaacaaaaaaacagaattttagaccaatatccttgaagaacattgatgcaaaaatcctcaataaaacgctggcaaaccgaatccagcagcacatcgaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaacacctttgacaaaattcaacaacgcttcatgctaaaaactctcaataaattaggtattgatgggacctatctcaaaataatgagagctatctgtgacaaacccacagccaatatcatactgaatgggcaaaaactggaagcattccctttgaaaactggcacaacacagggatgccctctctcaccactcctattcaacatagtgttggaagttctggccagggcaattaggcaggagaaggaaataaagggtattcaattaggaaaagaggaagtcaaattgtccctgtttgcagatgacatgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttggacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggtaacctacaaaatgggagaaaattttcacaacctactcatctgacaaagggctaatatccagagtgtacaatgaactcaaacaaatttacaagaaaaaaacaaccccatcaaaaagtgggcgaaggatatgaacagacacttctcaaaagaagacatttatgcaatcaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaacaggaacacttttacactgttggtgggactgtaaactagttcaacccttgtggaagtcagtgtggcaattcctcggggatctagaactagcaataccatttgacccagccatcccattactgggtatatacccaaagggctataaatcatgctgctataaagacacatgcacacgtatgtttattgcggcactattcacaatagcaaagacttggaaccagcccaaatgtccaataatgatagactggattaagaaaatgtggcacatatacaccatggaatactatgcagccataaaaaatgatgagttcgtgtcctttgtagggacatggatgaaattggaaatcatcattctcagtaaactatcgcaagaacgaaaaaccaaacaccgcatgttctcactcataggtgggaattgaacaatgagaacacatggacacaggaagggtaacatcacactctggggactgttgtggggtggggggaggggggagggatagatttaggagatatacctaatgctaaatgacgagttaatgggtgcagcacaccagcatggcacatgtatacatatgtaactaacctgcacattgtgcacatgtaccctaaaacttaaagtataataataacaaaaaaaaaaagaaaaaaaagaaacagggtactcagtaattatcctaggaatggccctactccttggtaactcaagagcagaaacggagttaacaatgttagtcaaaagtttcatcatatagtcagtaatgaagccttggaattagtgagcaaaagctacatgtaatttaatgacataaaaataacactcccaaatgaatatacaccttcaactcagtagtgggaattagttgccttttagggacctggtgcctgaagtctcttcagtgaaactgcttcattgaagccacaatgaataaactcagaaggtagcatcagaaaatgtttaagattgtcctcgccttccattgttcatattttggacccattggttcctaaaatgctgagcaaaatcaagacacaattcactgtaaaagcaagtgaagaatcgtatgccctggcaagaaggaaagaagccatatttgtttcttggaacaaatcagcatgaatatgtggaatggtcagtcttgacatggatctcccacgatgcaactgcaattcactccccttgaaagactctaacacctcagtgagctgacaatgttgcaatatacaaagggctatattaacacaactcttagagagcttagtagatttcgtcatatttatttattttgctttttgctattcagttgagtacaatacattcaattccaaaaatatttggtgacttcctgctatgtgccaggaagtgagccacgtactagagttacagaaatcaataaaatgtaggttctgctttcagagggcttataatataatctgaccatagtgccttgtttgtatcctcatttattcttctttctgccctccagaaaagaaagacaaccaaggtgttcactttctcatgagcgatacttcctaagtggggcctcattttaatataataatagataatacatatatagcactaaaattctatgatatatatactgcaattatcccaattttacaaccgaggaaactaaggtataaacaagtgaaacaaactaccaatgtcacatagtgtatcagtgatggatccaggattcaaacacagctgcggaatccattttcttaaccaccactctatactgcatgatatggataatagaaattcctgcctgtaagcactatccctttcataaagtatagtttgtgcttttgggagctttctgaggagctcagggaaaaaggatgatactccacatgtcccttaattttaatattgaaaatgaatcgaatcctcctgggaagcacactcttgtcttgcatggtaggtgggacgaggaatgcctgttttgagaaacctgtgtgaagaaaagccatgaagtgtacccaaaatatttctaaaatttaaaaagctgtgaatttatgtgtgggtatctctacatatgtctagttagtttagaaagattgtggctctcacagtgctaaaacactgaattattcaataaaaaaaatatatggttagtctggtgagatgcatttaaatcatatatatacaaaaatgtgttattttcccactatttatgctggcctttttttagtttgttttgcgatctttagggctataagatgatgaggactgtaagcctaactaaggctttatggttaaatatgtcgtcattctagtatgaaactttagtaccccttgaaaaagtatgtaccctgaaagtcccattcttgtaacactatttggaaaccagagttgtgatgtctaatgcacaaaggccagatcagctgacttttgtctcagtttcagtctaataactctatttcaagaaccattttcccttcatatttattctgttttctgattccaaacctgggaatatctacagaacaaaaaggagcattctacttctcattaaaggacaccaaggctctccttgtaggatgactctgtaatgagtagaaacaacttcagttagatgttgcacagcagttaagtagtgtttttcagattgcctggccttggttcttgattcctattcagagtctccttgttctgcatcaaattttattgaggatcctgttacaatctattactttacttcctgaattacttgtccataaaggtcttctgccttctgaggcttggtgtatgtcttgagtagagaatccaaaaagattatctatgccattaacctggatgatacttcctgctgcccagctcctaagacaaacctttccatccacagcctgctctcaccaaaacctgatacttgcctcatgagtctctgtaactatataccataaagacccaatattctgatttgtgactagaacttgatggatggatattacagaatatccaggaaaaaaaatcttgacttcaataatgagctggtctgtgataggattcatacttaataaaaccagaccaaacaaagtaaataaaaatttggatggatgaaaaggtgtaaagacactttgtttctggccgggtgcagtggcttacacctgtaatcccagcactttggaaggccaaggtgggcggatcaactgaggtcaggagttcaagaccagcctggccaacatggcgaaaccccaacatgtaattttagtctctactaaaaatacaaaaattagccatgcatggtggcacatgcctgtaatcccagctacatgggaggctgaggcaggagaattgcttgaactggggaggcggaggttgcagtgagctgagatcgtgccattgcactccagcctgggtgacaaagtgacactccgtttcaaaaaaaaaaaacactttgtttctgtttctaaaataatcttcatttcctcacttcactacaccaccttccctccatgcaaagggcaaactgtaggattttaaaaaggcaaagcattgaagtttatttctgagctacaaggcattcataaaactgaaaaacatgagatcctgtttcttatcatagacttttcaccctcgaacatttattttctccagccaatttaatgcactttcagtcaaatcaatttcttgacattaggtaagacagaagagtcaaataactggcactgattcattccacaaacatgtattaaacccatattttgtgccaggcactgtgtgaggtgatggaaataagccagtgcacaggacagtcggggcttcttctgtcccaaagtttataatttagtaagaatacagaaattaaatgttacatcaatacataaatacaaacagtgataagggccatgcaggacaagttcagggtgcgatgaacaattgtaacaaaaagatctgattttgatttcaaagaaggggtggtgttaaagaagacttttcttaaaaacttcattttcaacagaaaaccaaacgctgcatgttctcactcataagtgggagttgaacaatgagaacacatggacacagggaggggaacaacacacactggggcctgtcagggtgtgggggttgaggggagggagagcatcaggacaaatagctaatgtgtgcagggcttaaaaccctatcaaaccatgacgggttgacaagtacagacgtatacctatgtaacaaacctgcacattctgcacatgtatcccagaacttaaagttaaaaaaaaaggcccttttaagctgagatataatatcaaggattattaagagttcacaaagcaaaaaaagagtaggaagaatatttccagcacagagaacacaatgtgcaaaagtcctgaaatgtgaacaagcttggagtgcctcataaagacagtatggctggaacacgatgagaaaagacagtgcaagataaggttggggtcagatcatttagagtcttgtaggttttggtaataagttagattttattctaagtacaattagaagccctcaagtgggttttaagcatagacaggatatggttgtaattgtgtttatttgttaaagttgattctggctgctctgtggaaaatagactatagagaggcatgaatggaagtagggagatctattaggcaactcatctattagtacagatgagagataatggtggctctgactacataagcattataggtagatttgaaatatacgtaggaggaagagccaattggacttggtgactgattggatattcagggtaaggaagaagtgagagtgaactgggcacacattttatgtcatggatgtgaatcagctaaagacaaatatccatagtgggaaaggataattagcaattctgtgattcgggaatctgattacatttgaacaataagatagcaccttttctttaagaggagtgttcaaaagtaaagtccaacctccctcattttaaagatgaagaaattaagactcataatggatgtgctacttagcaaattaatcttatgctgtatatgaatgttttatctcccaaattaaaacataaagatccaaatgacattacttgttttgtagacatctcttcctaatagcacccaatatagagattgaggatatagcaaatactcaataattgcctctcaaattaaaatgaattgaattccttcttctttctcggcagatagaacaaaatggatattctggttattgataatggcagtgaagtgacagagttcatcctggtgggtttgtacaaccatccaaaatttcagattgccttttatcgcaccatggtagtggtctacctgatcacatttgttggtagcagtctcattattgttgtggttaaagttgatgggtggcttcacactcctatgtgttttttcctaagcaacctgtccttccttgatatctgctactccagcaattcagtaccttttttgttgttcaatggcttaagagactaccccaccatttcctataacagctgttatgcccagatgaccagtgctttttttctggggatgacagggtgtcttctccttgctgtcatggcttatgagagatttgttgtgatctccaatcccctgcgctacatcatcattatgaacaataaggtctgcatacagttggccatggtgacctgggccagtgccttccttatgtcattaatacaataattgcaataatacattgcaataatacattaattgcaatgattgcattgcaattcctgcccatttttgtggacacaatgtcatcaaccattttacctgtgaggtgcaggaattgttgaagcttgtctgctcagacatcccaggcagcctcatcctcggtctagtcatcggcatattcaccttgtccctgcccttcaccttgcccctgcccttcaccttcatcctcttcgcctatgctcacattgtggttgctgtgctgaggatcaactctgcagaggccagactcaaagctttctccacctgtggatcccatctgactgtgatcatcatattttatgggacagccacctacatgtacttgaaacctcagtcaagggaatcccaagatgagggtaaagtcatctctgtattttttttgaaagtattttttattatactttaagttctggggtacatgtgcagaacgtgtagttttgttacataggtatacacatgccagagaagcaacatcaaaatgatagcatctctgtattttatggtgttgtgacccctatgttgaaccccctcatttacaccttgagagacaaggatgcgaaaatgctctaagaaaaataattaggaagaaagagtcctaaaagaatgtgaatatcgcatggaggctcatctaaccaacagtttgatattgacttgtaaaaataacaaggtagaaatactaaacaacattttataagataattaaagtgttttctctatttccaacaggcatgtaaaatctttccactgagaaaaaaaatgttaaacttttatagtaccaccatttaagtagtacacagggcagccttgaaggagagttttaaaataaaataataattagtacattgtaatcctgagcagtttgattttattttactaaattggaaatattctattataatataataataatatgctgagattcccttttttaggtgaaaaagagcaaagttgcaaaatcgacaattcttatctcaatgtttttggtgtaaaatgtgtcataacccacactttgaagtgatggaggtgagtagagagaaaaaaattacttaactactacataagtgtctgcatagaaggtcctctgctaaagcaaggaggccttcaagactgtgaacctactgagaactagaactgatagacattatggaaaatgcaattacatgtcttgatcagtagatagggctatattttctctatgagtgtgcactattccttccaacttccaaaggtgatctaaaggtgttgaccttacaaacacagcaaatttaactcaggaggaatgtcttttaaaaagcaaatatatacagtatttttaaattataatgttaattatttaaaagtagataaaacggtagagaataaatttaaaaatcacctataattccaacactcaatgaggcttgcatcagtttggggttcagatatgcatgtatttaagtctgctatgcacaattatttcagattcagctcatcactttccatatttacacctcagttttctcatctataaaatggggattataagagtgcctacctcacaaaagtggttttgaaaattaaatgtgataatacaagtcacatttctatcacaatgtctagcatatggtggacattgaatatgtatcaaccaaaaaaatacctgtcaatttgccctttaaaatccacacccattgtatgagtggtcatttgcctatgtctataccaataatgactgtatcatttaaaaatattccatgacaatatgacagactgaaaatttgtgtttattatcttattatctttgaggttgggtcaaaatgtcagtgagtcagcccaactctggaaaaaagaaaatactaaactcagtaacgtatgactaataaaagcttccaaacttgtttcaatctaattgactccaccattgcttctggatacatcctggcaggtacacccaaagttggatctattctatttcactctggtaagcactcctggaattaatactttatccatcaacaacagaagctgactgaagactattgtaagtgcaaacaaaaatgagaaaagcatgggaaccccaataaagaactctttggaaaagaaatctatggtgctatacaaattttgtcgtaacattatcaatttaatcctgaaaaaattctcatgtaagtttaatttctgatgttttctaatccttctcatctaacctaacgcaaccctgaaactagaaggaaggtactattaactaacaagaagacacagtgagcagatgaagtcaaacactagaggatggaaacaaatatgatttctcagatgtaagggggaaaaagggaggaaaactgcaagcctaatacttattagagtttgatcattttcattaggaactaagaggaggtagagaggaacaagaaatgagatgtgccttgtgctgacagagagaaatttatcggggagaggcagggacctttttagctgtgagagaaaattagacaggtaaactaatttctttccttttgattacctcaaggagaagttagacaagactctctctagagaaatgtgttacatctggaagtggagaacaagctacaggaagctttctaacatgaagtcaagactctggatgagtagaaaatgtaagaaattataagaacaactgttcagttatagttgaatgtgttaggtgcctttatattaaaagtttgctgtgaaatttgccttctccaaatcttccttgtattacaaaataaacaagtctgagtcataataaataagcaatactttagaactaccctaagccttgggaaatttgtttaaatttcttatctctgccaaacagcagttatgactcgtagctgataatggacaactctgcgtctctgcacaccatctcctcataaggtgtgccaaaatcacaaaacaacatcttagaaggttgaactgaccccttaaaaaatcaacatcgctgagaaaagagcttcgtgctgtgtactggcagcagcagagcaaacaaaatgcacttgagcaccataaccacaacttttccaggaagtatttcacagaaataaattttaaaatttgaaaaaaattaagaagaaatcattgaacttttagtgaatttgtcaacaatgtcagtactaagtagtaagaaaataaaattaattacctacagaatggtcctttggttttaacaagtcatgaaagcagaactagtcaatctaccattttcatcacgtagaaaggagtacatagaaaagtgctcatttgttcctgcaattttttgttgtcgttggctcaattaaaataatcatcaaataaagtttttcactaatgcatttgagtcatggccctgtatgcccatatctgcttgtccacatatatacatggacatatacacacaagctttattgtcagaaagacctgaacttgggcaatatattttaacccctctgaaaccctcattatcagctatgtagtatagaatataataacctctacttcatagtgctgcttatgagcataagataaacagtgtaaaacacttagtacagtacttggcaaatagtaagcaccttaaaatactttattacttttactattcccatttttattatttttaattgacataataattgtatatatttatgggatacagtgagtatgtgataatcaaataaggttaatttacatattcatcacttcaaacatttatcatttctttgtgttggaaacattcaaaatctgttcttctagctatttgaaaatatacaataaatattgttgatttcagtccctctttagtgctacagaacactagaacttattcctcttatctagctgtacctttgtacctgttgaccaaactttggctatcctctcttcctcaaacctttccccatctctagtaaccacaattctagtgtctactcgtatgagatcaacttttttgcatccacatgtgagtgaggacatgtggtatttattcttccgtgcctggctttttccattttgcataatgacctctaaactcatccatgttgttgtgaattacagaattttgttctttttatggctaaatagtattccattgtgtatctatgacacattttatttatctattcatattttgatggccacttaggttgattccatactttggctgttatgaatattgcttcaagaaaacatgggagtgtggatatctttatgaggtggtgatttcattctcttcgggtatatacccagaagtgagattgctggctcatacagtaattccatttctagttttgtaaggaatctttatactgttttccataatggctgttcttatcatcatcattagtattatataactctagtaccagagatgcccttatattgaaaggcttaatttattctatgtgtagcaaggttatcacacttttcttgactaaagctcatacagggaattatagagagcatatacaggcatgtgtgtgtgtcaggatgtaagtgttgaaggatgtttcacactttgcctctttttgcaccttacttcacttattcaaccaatatttattgaatatattctatgtgttaggtgatttgctagcactggggatctacaggaaaaaaagacaaatttcttgctatttgttagtagggactaaatgttttaaaatacagacattaagcaggctatcacatttataagcaaaacaatttgagagcataagaagtactctgaaggaaacaaacagaaagctggagcaaagagcaatgagtgagacttccttatgatagaattttcaggtaagagctctcaaaagaaattatatttaaactgagactgaaggattcacattaaatgcttagtacaaatattgaagagtgaggagatgagtatactagaatgaagggggaaaaaaatgtaaaggcctgaaagaaaggaagaactgagcatgtttaaggaacaggaagaagacaaataagtgtaagttatgtgagcaagggggtgggtaggtggtatgtcatccattccttcattcatccattcaacaaaaataacaactaaacacaaacacacaaataacatgtgtgcatgcgcacatgcactcacatagtacacagagacagaaagagaagccactatgtgtgccaagcactgttcttggctttgggaatacctcaacaaataaaaatgtctccagactaatgaagtggtatgttattgagaaagagacttaaaccataaatataaaccatatagtatttttttaaaataaaagcaatggtaagatatataaggagaaataggttaggagcttccattttaattaggataatttaaaatttcctacatatgtgaatatgtaggacaataatattccaggcaaaggcactaagacaaaagaatgaaaaatgtatttgaagaacaccagggaagccagtgtgattggagaggagggagcaaaatagaagaaagcatcagatgagctgagagaggaatggggaccagattgttcaggtacttctagaccattgtagggtacatcatgcaggtacttctagaccattgtaagggttttagtttgttttatttaaaaaaataaaaaagcttcattgagatataattcacataccataaaattcagtattttaaattgtacagtttagtgacatttagagcattcacaaagatgtgcaatcatgttataaatattatttgtctattcttcagttgcttgtccctatattttcagatataataagctttaggatataaatacagatgtgtttgcaaaactagaaaaaaagaggaattcacgccacagcaatagatgaagtttccaatttcttcacatcctagccaatgtttattattgtttgtcaagtttattagagccatcttagtgagtgaaaagtggtatctcattgtagttttgatgagcattttcctaacactaatggtgttgcatatattttcatgtgcttatttgccatttgtacatcttttttggagaaatgtctttgcatatcatttgcccatatttaattgggttatttttctttttattattgagctgtaagagctatttacatcctccaaatataaattccttatgggatatatgatttgcaaacattttgttccacttcatgggttgtcttttcaattttttggtaatgtcctttgaagcacaaagtttttaaatttgatgatgtccagtttgtgttccacttccttttgtggcttataattacgttgtcatatctaaaaaccattgcctagtctgatgtcacaaatatttatctctatattttcttttaagaattacaaaattttagctctttcagttaggtctttgatccattttgaattaacttttgtatatgatatgagataaggttcaaacctcatccccttgcatgagggaatgatgcagttctcccagtatcatctgctgaaaaaactattacttcccccatctacttgttttggcaccttgtcataccatatgtgcatatttatttttggatattcaactctacttcactcactaatatgtctgtctttaggccagtaccacacagctttggttaccctattcttttaataagttttggagtaggggattgtgactcctccaactttattcttatttttcaagatagttttggctgttttagatcccttgcattttatatcaatttttggtttcttgcatttctatatgaatgttgtaaattccaacagggaaatagatagagattgtgttgagtctggggatcaatttggtaagtattgctatcttaacaatattaagtcttctaagctatgaaaatggaaagtttttccatttacttaggtcttctttactttctttcaacaattttttgtagttttcattgtatgtatctttcacttcatgtgttaattttattcctattttatcctttttgacactattataaatgaaatcgttttcttagtttcatttgctggttgtttattgctggtgtatagaaataacagtgattgtgtatattgatcttgtatcccacaaccttgttgaatttattaattctaatagtttctgtggactctttatgatattccatatacaggatcatgacatctgtgaatagacctaattgtacttcttcctttccaatctggatgcttttatttctttttcttgcctaattgctctggcaaaaaattgtagtacaatgtcacaaaaaagtggcaaaagtagaaatgctggtcttcttgatctagagggaaagtcttcagtctttcaccactaagttgatgtcagctgtgtgtttgtctataataaaaatatttatcttaaagtctatttcatctaatattagtttaggtccaccagctctgttgtgggtgctttctacatactatatatttttccaaacttttattctcaatctatttgggcgtgtgaatctaaagtgagtttcttgcagatagcatatagttggatcatgttttaatattttttaatccctttggtcaatttctgtccttttatgtaattattaatgataggatttaaatatgccattttttcctttcttttctgtatgctttatatctcactttttcctgtatttctccattattatcttcttttgtgttagagagaaattttccagtatttcattttaattccaatattgtttattttatgatatttttgagctatatactcagtggttgcattagagattacaattaacatcttaacatatcacaatctactttggataagtaacacttaaattccaatagttatatataaacttagcttttatattactcagtttcttcctcattcctttgtcataatgatgtcagatggattttataaacccattaacacagatttgtaatgatttccttaggaaattgtcttttaaatcaggaaggagaagaaaatagttaaaaatcatttatacatttttattctatatttatgtatgcagtcattttaacagtgttttttatttcttcacatggatttgagttactgtctagtgttcttttatttcagcatgaaagacaccctttaatatttcttgtaagtcagggttgctggcaacaaattctgtcagtttctgattatctggaaaattttttattttctccttcattttccatctagcaaaggatagctctgctagatatagaattcttcattgacagcatctcttctgtatattttaaatttgttaatccactgccttctgggctacatgatttctgatgggaattcacttgttaatcttactgagaaacttttgtacatgatgagtcactcttcctcttgctgctattaaaattctctctttgctttggcttttgacatgttgattatgatttatctaggtgtggatctctttgaatttatcctactcaggaaatgttgagcttgttagatgtatacattaatgtgtttggtcttatctggagagttttcagccattatttctttaaatatactttttccttttatttcttcttttggaacttctattatgcatatattggtatgcctgatgatgtctcacaggtctctgagtttctgttcattttttttgttatttcttcctgtttctcagacagtatactctcaattaacacatattcaagttcatttattctgtcacctgctttctcaaatatgctattgagtctctcttataaattttctattttagttattctattttcaactccaaaacccctatatggttatttttaaattttctatcttgttattaatattggctattgggtgagatattgttattacatttttcttaattctttagactttttttatttctttgaacatatttgcaatagctaatttgtagtattatctggtaagtctaacatccgggcttcctttggaacatttcctgttgattgcttttgtttgtgtgtatagaacacactttcttattttggaggggctcataattttttgttgaaatatgtacattttaagtgatataatgtaaaattctggaattcaaattcctctcattcaccaggatttgttattacggtctattgcttttgttcttgcagctattttattgttagtgactttcatggattatttaaagtctgtattatttgtgctgttcaactactgaattgtctgcttggttagcttagtagtcagctaatgactggacagagatttaattaaatgtcttgaactaataagtctcctagccgtgacagaggggctctgtttgcatattgtggcacacattcaatgctctctcaggcagtttacaactccggcttaacctttataccctgcttgcagagcttcaaagtgaacgacaggcaagaaataggatcttctcagggctttcctggacattcacatagtctacatgtgtccatgtgtggctttctagatcctatgagtgtgctaaaacttttcaaagctctttatggccatctcgtccaccagtttttctttttaagtattttagtcagtcttttgttagtaccaactggtaacaacacctcaagtagctgccctgttaaacaacttccactgattcttttggcaaatgtcctgggaaaagggttatttacacagtgacttattagtcagctcaaataaaaagaaccccagaaaatgtgcttttcaacaatctattagaaaagtcaaatcgtggcaattctgtggggaggtggttttggggaaaattcaaacctgttataccctctcccatggtggctaagcttctggttttcatggctgctatcattgtgaggctgttgattttcaaagctatcatggatttagggagaacaaatgggattcgggcaaattaaaacaccatgaaggccacttctcattaagatgatgttttctttcttgaataaatgcttcttagattattgtaaatttttgattaatttccagagttctaaaaaaatttgctttgacaattgttgtcagtgtttctattacttttatagagaaggagatttttggagttacttacgtcccattttggaggttcttctcaaaggctttaacttttactttgaaggaaatggtaggtttttaaaggtatttgagaagtggagtatcctgattcaacttacattttaaaagggttactctgactattgtatgaagaatcaactttaatgggtcaagggcagaggcatagagactacttagaagaatatttcaacagcttaagtgaaagttgatggtggcctagaacaaggtggtaataaaaagtggtgggaagtgacaggattttgaaaataatttgaaggaagagtcactaagatttaatgatggattggatcaggttgtgaaaaaaaagagtcaaagatgactcaaatgtttgtgttctaaataactggaatagagaatggacataatgaagatggggctatcagaaaatattttggagagaggaggtacgaagacagagtgagagttaaatttttcacgttaattttgagatatccattaaaccaaaaaagaagcaatgttagttaagaatttgattatttgagtctgcatttcaggggagagatgtgaattggaaatatgaatatgaaaattgtcaacatatagagtatatttaaagccacaggactggatgaggtcactaagggataagtagctagaaaagacaaaaagtccaagaactgaggcctgaggaattccaatcttaggaggttatggagaaaaaacaaccttaaaagaatactgaaatggaggggctagttagcgtaggtaaatcaggagagtgtattgttttgcaaaacaaagggtatgaagaagagtgatcaaatctctcaaatgctgccattaggccaagtaagggaagaacagaaaattgaccagataaactagcatttcctatgaagtaaaataggcataaacatcatattgtgttttgttaacaggttactgagaggctaagtgagattacatggctgtcccccatcctgagatagagttatataatatgtggggagctgcagataactttgacatcttctatttttgcttgcaaacacatctgcacattttattctgtgagatgtgtcatgaaaagtttatttttttctcttttgaatgtttttttaaaagagaaccaatttgaggtctggcaatggcagagtggcttgttttggacaatcatctcacagatttacaaaactctgtacaaaatattaaaaatgagctacagtcaactgctgcataccaatgtttcggtcaacctgactgaatatataatcgttgtcctataagattataatgacactgaaaaatgtcagtgatatcagagctgtcatgatgtagtgcaacagattactcacatagtcatggtgatgtataaacaaatcttctgcactaacagtcatataaaagtcaagcacatacaattatgtgtagtacataatacttgttaataataataaatgactatgttactgatttatgtatttactatactatacttaattatcattattttacaatgtactccttctatttatctttgtaagttaactgtaaaacagcctcaggtagatccttcaggaggtattccagaagacattattttcataagacacgacaacttcatgcatggtattgcctctgaagaccttccagttgtccagcgggacaagatgtggaagtgaagatggtgatattgatgatcctaaccctgtataggcctaagctaatgtgtgtttgtttgtatcttatttttttaacaacaaagtttaaagagattttttaaaaattaggtagaaaaaaactcataaaataaaaatataaagaaaatattttgtacagttgtacaatgtgtttgtattttaagctgtgttatgagtcaaaaagtctaaaacatttgaaaagtttataaagtagaaaagttacaccaaattaagtttgatttactattgaagaaataaattttaaataaatttagtatactctaagtgtacagtgtctataaagtctgcagtagtaaacagtaataccctaggccttcacattcactcaaaactcagtcacagactcacccagagcaatttccagtcctacaagctccatttatggtaagtgccctatacaaatataccatttttaaacttttatgccatattttactgtaccatgtctatgtttagatatgttcgtatgattaccattgtgttacaattgcctacagtattcagtagagtaacatcctgtacaggtttgtagcctaggaacaataggcagtatcacatagcctaggtgtgtagtaggctataccatctaggtttgtgtaagtacactctatgatgttggcacaacaaaaaaatcgcctaatgatgcatttctcaaaatatacccccaatgttaagtgacctatgattgtatttgaaggtactggagagcacccgaaagcagacagaaactggactgcattcaactgctaatagaaagaaaccacactgagtaaggtccatatctatgtagttttctcctaagggcactacccaggaaatttgatgtgaggtacctagaacgcaaggagaaatctcaagtcatattggtttgaggtattagaaaatgggattgggacttgccagagcagctaaaaattgaagaggaaaatcccagaaaggggagtgtcacagagaagtgagttctaatttttatgtaaaataccctaacacaaatatgtacagaaaaaacaataagaaagcttacagaaagcaacagaaataaggcaaaaaaaaaaactgaaacagatatttcagtgtttgctcaccatagggagacagagcctagtgtgaattccattaatttaggagaccttgataaatatcttaattgaaacagggtcttgctctgtcacccagtctggagtgcagtggcatagtcagagctcactgcagtctcaaacttccaagctcaagtgatcctcgcacctcagcctcctgagtagctgggaccacaggcaagcgccaccatgcccgactaatttttgtattttttgtagagatgggattttgccatgttgcccaggttggtctccaactcctggaccaaagggatcctcctgcctttgcctcccaaagtgcagggattaaacaggcataagccactgcgcccagcctataaatgtattagactttctgttaaaattctggaaagaccataccttaagaataaggactatctccaaaggttaaggatcccctgtaagcaaaactagtcagatccagactaacaaagtatcaaatgaaggctccaaaagtttaagataatcagcctatgatttaaaagtcagctggagtgaaaatcaaaacactcttagaagaaaatataagaatcaataatctctaaaaaatattatcaagtttccactacgcaaccaaatatcactagagatgaattttcaaaaacataaaatcataagaaaaaagttaatacaatgaatctgtaataatccagatgttaaattagcagatgacattttaaaagctattataaatatgttcaagaactttaaaaagataaggtggtcaaaacaggtggacaaatgggtataccaacagataaatcaaaattataaaaaagaccaaatggaaattctaggactacaacctatgacatttaacatgaaaactggctggcagataacagggggaaaaaattggtagtaaacttggagacagagtgatacaaattatcctatgtgggaaaaaagtaaagaagattttttaaaacataattaaccacattgactgaattcacatttctaaaacactgctgggtcataaaatatgtcttaaaaatttcaaatatggaaatctaaataatatgttttctgaccacaaaggaaataaaattagaaatgaacagcagtagaacatctcaaaaaaactcacatatttggaatttaaatcacatactaataagtaacacatgaagaactcacaagaaagattagagaatacttcaaacaatgaaaatgaaaatacaatacaaaaatttgtaggatacagctaaaacagtgcctcgaagaatatttatcactttaaatgctcatgtttaaaaagaagaaaggtttaaaatcaattatctacatttcaactgtagaaaagtaggaagagacaagcagattaaacccagtatgaaaagaagggaagaaataatctaaataagaatagatacacataaacaagaaaacacaaaatgagtaaagctaaaagtgtgttcttttaacatatttattaaatggttaaatcacaagcaaatctgattgattaggggaaaaagagacagagatgactttcacttttggtaatagctgagtaagatcttactagaccaacactcctgcaagtaacagctacaaattccagacataatacaaaatacagccaactggagacactggggagaaaatagaaaagaacagaatctaatgaagaggctatacttggaagagaggagttgcacaaaatgagttcccattttcatggttttagcttaaggctatgtgtaggtagcaaggtgggcagagtggtagtggttgggggaaggcagtctttctcttctggggatacagaaaactgaatctggagaaacaacagtgctgtagaaagagggaatatcccacaaggaaaacaccaagggaatgaatccctaaattctgtctgaccatatgtttgggtgatgctgaatcacgcagcaggtttaaagaagttcagttgaatataaaagatatgaaataagactgaagattccacccaaaaagcagattttgcagtctgaatataactgacataattgccagttaaaacaaaagaaacgctcatcagaaaaaagtaacagaatttatatactctacaatttaacatttatcatgtctgtgatgcaatcgaaaatcattcaacgtataaagaaacaggaaaatgttatacattctcaatacaaaagaaaatcaactaatactcatcactagctgacacaaataacagaattggcagacgtattttaaagcatttttctagctattcttagtgaagtaaaaaaaaaaatacagtcatgcatcgcataatgacgtttcagaaaacaacaaactgcatacatgatggtggtcccataagattataatggagctatataatggggtaggctataccatctaggtttgtgcaggtacactctgatgtttgcacaataaggaaatgcctgacaacacatttctcagaatgtatctccatcataaatggcgtaggactatatttgaaatgaatgtaaagacagaaaatctcgccaagaaaaaaaaagaaacaaagaaaaaaaagcctaaatggaattacataactgaaaatacaatctctgaaattaaatacactggacttacttaaaagcagaatggaggagccaagatggccgaataggaacagctgcgatctacagctcccagcgtgagcgacgcagaagacgggtgatttctgcatttccatctgaggtaccgggttcatctcactagggagtgccagacagtgggcgcaggtcagtgggtgcgcgcaccgtccgcgagccgaagcagggcgaggcattgcctcactcgggaagcgcaaggggtcagggagttcccattcctagtcaaagaaaggggtgacagacgcacctggaaaatcgggtcactcccacccgaatactgcgcttttccgacgggcttaaaaaacggcgcaccacgagattatatcccacacctggctcggagggtcctacgcccacggagtctcgctgattgctagcacagcagtctgagatcaaactgcaaggcggcagcgaggctgggggaggggcgcccgccattgcccaggcttgattaggtaaacgaagcagctgggaaactccaactgggtggagcccaccacagctcaaggaggcctgcattcctctgtaggctccacctttgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtactccaacagacctgcagctgagggtcctgtctgttagaaggaaaactaacaaacagaaaggacatccacaccaaaaacccatctgtacatcaccatcatcaaagaccaaaagtagataaaaccactaagatggggaaaaaacagaacagaaaaactggaaactctaaaaagcagagcgcctctcctcctccaaaggaacgcagttcctcaccagcaacagaacaaagctggacagagaatgactttgacgagctgagagaagaaggcttcagacgatcaaattactctgagctatgggaggacattcaaaccaaaggcaaagaagttgaaaactttgaaaaaaatttagaagaatgtataactagaattaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacgttcagattcaggaaatacacagaatgccacaaagatactccttgagaagagcaactccaagacacataattgtcagattcaccaaagttgaaatgaaggaaaaaatgttaagggaccagagagagagaccagccaggaaaaaatgttaagggaccagccagagagaaaggtcgggttaccctcaaagggaagcccatcagactaacagcggatctcttgacagaaaccctacaagccagaagagagtgggggccaatattcaacattcttaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccactgcaaaatcctgccaaaatgtaaagaccatcgagactaggaagaaactgcatcaactaatgagcaaaatgaccagctaatatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaagggcaggggttgcaatcctagtctctgataaaacagactttaaaccaacaaagatcaaaagagacaaagaaggccattacataatggtaaagggatcaattcaacaagaagagctaactatcttaaatatatatgcacctaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcggacctaatagacatctagagaactctccaccccaaatcaacagaatatacatttttttcagcaccacaccacacctattccaaaattgaccacatagttggaagtaaacctctcctcagcaaatgtaaaagaacagaaatcataacaaactatctctgaccacagtgcaatcaaactagaatgcaggattaagaatctcactcaaaaccgctcaactacatggaaactgaacaacctgctcctgaatgactactgggtacataacgaaatgaaggcagaaataaacatgttctttgaaaccaacgagaaaaaagacacaacatgccagaatctctgggacgcattcaaagcagtgtgtagagggaaatttatagcactaaatgcccacaagagaaagcaggaaagatccaaaattgacaccctaacatcacaattaaaagaactagaaaaacaagagcaaacacattcaaaagctagcataaggcaagaaataactaaaatcagagcagaactgaaggaaatagagacacagaaaacccttcaaaaaattaatgaatccaggagctggttttttgaaaggatcaacaaaatagatagaccgctatcaagactaataaagaaaaaaagagagaagaatcaaatagacgcaataaaaaatgataaaggggatatcaccactgatcccatagaaatacaaactaccatcagagaatactacaaacacctctacgcaaataaactagaaaatctagaagaaatggataaattccttgacacatacactctcccaagactaaaccaggaagaggttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaacaaaaaagagaattttacaccaatatctttgatgaacattgatgcagaaatcctcaataaaatactggcaaaacgaatccagcagcacatcaaaaagcttatccaccatgatcaagtgggcttcatccctgggaagcaaggctggttcaatatacacaaatcaataaatgtaatccagcatataaacagagccaaagacaaaaaccacatgattatctcaatagatgcagaaaaggcctttcacaaaattcaacaactcttcatgctaaaaactctcaataaattaggtattgatgggacctatctcaaaataataagagctatctgtgacaaacccacagccaatatcatactgaatgggcaaaaactggagaagcattccctttgaaaatgggcacaagacagggatgccctctctcaccactcctattcaacatagtgttggaagttctggccagggcaattaggcaggagaaggaaataaagggtattcaattaggaaaagaggaagtcaaattgtccttgtttgcagacgacatgattgtatatctagaaaaccccattgtctcagcccaaaatctccttaagctgataagcaacttcagcaaactctcaggatacaaaatcaatgtacaaaaatcacaagcattcttatacaccaacagaagacaaacagagagccaaatcatgagtgaactcccattcacaattgcttcaaagagaataaaatacctaggatgtgaaggacctcttcaaggagaactacaaaccactgctcaaggaaataaaagaggatacaaacaaatggaagaacattccatgctcatgggtaggcagaatcaatatcatgaaaatggccatactgcccaaggtaatttacagattcaatgccatccccatcaagctaccaatgcctttcttcacagaattggaaaaaactattttaaagttcatatggaaccaaaaaagagcccgcattgccaagtcagtcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattcgacctaaaaccataaaaaccctagaagaaaacctaggcaataccattcaggacataggcatgggcaaggacttcatgtctaaaacaccaaaagcaaaaagcaatggcagcaaaagacaaaattgacaagtgggatctaattaaactaaagagcttctgtacagcaaaagaaactaccatcagagtgaacaggcaacctacaaaatgggagaaaatttttgcaacctactcatctgacaaagggctaatatccagaatctacaatgaacttaaacaaatttacaagaaaaaaacaaccccatcaaaaagtgggcaaaggatatgaacagacacttctcaaaagaagacatttatgcagccaaaaaaacacatgaaaaaatgctcatcatcactggccatcacagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacatgtatgtttattgcggcactattcacaatagcaaagtcttggaaccaacccaaatgtccaacaatgatagactggattaagaaaatgtggcacatatacaccacggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggtgggggggaggggggagggatagctttgggagatatacctaatgctagatgacgagttagtgggtgcagcgcaccagcatggcacatgtatacatatgtaactaacctgcacaatgtgcacatgtaccctaaaacttaaagtataataaaaaaaaaaagcagaatggaggtaacagatgaaaggttaatttaacttgacgactgaccaatggaaacaacacagaaaaaaaaaaatcactggttaaagaatgtataaagcctcagtaaccagttagagaatacgcaacagtctaacataagtgtaactgtaatcccaaaataataaaagacagaaaatgggagagaaaaatagttgaagataaagtggctgaaatttcccaaattgaaacaaaagcataaattttacaaatttaagatgtccaaatcatcaagtaaagtaagcatgaaaaaggccattccaaggcaaatcatagtcaaattattgtcatccaaggataaagaccaaatctcaagagcagtaagagacaagcaatattatatgtatgtgtgtatatatgtatatatatatatatgaaataattatattaattctcatcagaaaatatagaggcaaaaattgagtagaagaatatctttaaagtactgaaagaataaagcaaaacattaacccagacttccacatgcagtgaaaatattctttaagaattaaagaaaaatagtgacatttcaagtaaaatgaaatagaagctacaaaatttgtcagttgcagaacgtcattataagaaatgataaaatgagttctttatgctgaaaggaaattttgacagatgaaaactgagattttcagaatagaataaaaagattgaatattatacatatctgaataagtatcaaaacattttttgctcttttcactgtaatttttttgtaattcatgcgattgctaaagtaaaaagtatggcattgtcttatgggattaatatcacatttaggtgtaataaatgtaacaataatagtataaagcaggggtaggcaaacttattgtataagggaccagataataaatattttaggctttgcaagtcacatggtatccctgtcacatgttctttgtttttgtgtttataatcctttaaaaacgtataaacattcttagctcaagaattatacaaaaactggttgcaagacagatttggcctataggccacagtttgctaacccctggcagatacccatatggaaaaccaaaatgaacctttactattacctcacatgatactcgaaaattaattgaagatagatcataaagcaaaagtatacactaaaactacaaagcttctagaagaaaatgtaggagaacatctttatgacactggcaatgacaaagatttcctggacagaacacaaaatgcactaatcatttaaacatggataaactaaactttatgaaatttaaaaatgcccttcgaaaacaccattcaggaaatgaaaacacaaatcagtaacaaaaaaaaattcacgatgtttatatttgacagaatattatatttggaatatataaaaactcttaaaaatcaataacaaaaagacaatccaataaaaataggcaaagacgagcatatactccacagaggaagaaatatgaattgacactatacacttgtactcagcattatttgtcatcagggaagagcaaagtaaaaccacattaggagggttgtttgtttgtttgttttgagatagggtcttgctctgtcacccaggctggagtgcagaggtgggatcatagctcactgtaacctcaaactcctgggctcaagccatcctcccacctcagcctcctgggtagctaggcctacaggctcatcccaccatgaccagctatttttttttaatttttgtggaaacaagttatcactctgtggcccaggctggaagggggtgatcttaagatgaaaagtgaatgagaactctctgtactatctttaaaatttttatctaaatctaaagttatttcaaaatagtttttaaaattatattctaccatatactcaccagaatactgaaataaaaaataccaacaacaccaaatattggcaaggacatggagcaaatggagctcgactttcctatgtcacaggtgggcatgtaaaattgtacaaacctcttcagaaaacatttgaaaacttcttaaaaattaagcctatgcctactctctgacccagcagctagtttcctagatattccccactaggaactaaaaacatttgtccacaaaatgacttgcacgtaaatgttcatagcaacaatattcaacatagccccaaatcaaaaataaccaagtgtggcatattcatacaatgaaatgttactcagtaataagaaacaataaataacgaatatatacaatgacacagataaatctcaaaaatgttatgttaagtaaaaaaaaaaagatagacacaaaaatgcatagtgtatgcttccatgcataagaagtgcaagaactggcaaaactaatctgggggaatagcaaacagaacagtggttgttgatgggtgtagagattgaccgggagaaaacacaagataacttttcagaattgtagtcatgttctatatctttactgaggttgtggttatatagttatatacatttttggaaattcatatattttacacttaagatatgtatatttcactatatgtaaatttcacttcaatattaaaaagacagaaaacataatctcaaggaggcaaaatggattcctcacagttgtattttaaatccatgcaggtgccttcagatctagattccactgtctcaacaaacacctttatactagataactgatactccaacaataaaaatgaacaattccatactcttagcacttcaagttcagtatcaaatgtatgaaagaccaactcactgtatctgtttctcttcttctttcttcagatgcagatctcagatatattttcaactacgaatagaatgtgagttcttcatggaacacttcgactttgctctccaacttatccaggccatattcccaatggcaagaattataaatgcatttcaaccaccgcattgggtttataacatttgaaggaaaggccaaatagggaactgtcaagcttttgctggagaaccaaaacagtaagacaggcacaagatattgtaccccagtgcttagcctgtcgtgttgtaacataactaaaagctatttttcactcgctttgctttaattaccaagggttttggtgttctaaattgctactgtccaagcatcccctgatatagctgtagtccaagaagttgaaggggtcctaagggaattaagggaatacagctgcagcccccaacaaatacctcaaatcctaaaatatgcaaactctacagaatgattgatggtatattctcagtattacttcaaacttcataaagtgcttgcaaacacaattatcacttcagctacatcctccctgcttgtgaacttgctgaaaaaatctgcttcttaataatagcagctaccatttgttaaacactttaatcaagcactgctgtgtgttgttttgtttgatcctcccacaataaccttattacataagcattactacaatcatatccactgccagatgaaaaaactgagatacagagaagttagaagtcacacaattagcaagtgtcagagctgagatttcaactgattgcctgacagcggcactctcactcaaacagtaagctatgctgctttcttgctaaatctttatcatgcccatagcttgggtttgcctacaaaaaaaagtttgagccatgaatacagcccttgacattttattgaccatgacagaggaaaaaaggtggcacatgatcacacttacgaaattgtttcaaggaaagaaaaagtagagaatcacaaggacaatctagttatgaaaatatttacctgaatagtctctgtaatcattgtagagcaggcaagagaaataataagttattgcccagggactccatcccctgagcattcaaaaagacaagaactccttcacaattgaatttatagccattaaatgttttcattgcaatgtttgctttcttattcaagtgactgactccagttggaaatatttggggacctcaagataaagccttgatgggaatgtggcatgccttacaaagtgttacaaaaagcaggtccaggatatgagactttatttcttcttaggcaatacactgaggtacctctgggtccagctcttaaaagctaatgcttccgttctcaagtaggcagtggagccactgttttctcagaataagaagatacttctttcagtttgtgtgacatttgtgaagaagaatttttcaagttttcctgaacacttttccatatttgttgcaataatagaagactattcaaattaacctcatccattcaggtatttaacatcaatatattcacattcagagataaaaggaacttttctatctggagagcttcttattaactgttcttatctggtcaaatttcactagtcagaccacaggaagttgtagatcctagcactgcccggatattggactttctcccacatctctgcctgggaactgccagctgagttattgctgtcggagaagtatgcagtgtgtctgggctttggggttatctgatcagcagaggcatcggtgagtaaagtttattttttcccctagccaaagaattataaactctgagtattaggcccggaataacctaaaaggtcatcttgtccaacttctagtcaatgtctgcatcacttgaacagcacatttaggctcctggaataataatagagtagaaataaacttgagtgcttactgtataccagagatgatgctttatacataaactcatttaatattcataatatcaatctgaatcagaaattattttgtagataagaaaactaaagctctgaaatgttagacgttttgaccaagtccacatggaagtggcagggccaagattcaaacccaggtctgtctgcagagcccacacttttaaacaccacattgttcttcataactcaaatatctgggaaaactctgtctaatattccatcgtgttgtttctaaaagttgactcatacttgtcagaatactcatatcagtgtcagattcagaaaatttagttaccatgcttcttccttcttatttaaccccttcctctcccaccaatagcaacaaatctacttttatttttaatattagccctgtattccatggtgagaaaaaaaactgttggttagcagaaacataaacctggtcatcaaatcatgaaattcaaagacaaaataaaagcctttcttgaaagaaaacaggaaattaagaactaaagataaacctgcaataaccattaataagtaagcagcagctgggcatggtgacgtgcatttataatatcagctacttgagaggctgaggtgggaagatctcttgagcccaggagctccaggctgcagtgagctctgattgtgccactgtactcctgcctgggcaacagagtgacaccctgtctctaaaaataaataactaactaaataaaataagctagccccaaaagttccactgagttccaatttaaatagactaaagatcccctggtcaaaatgcatctctattgttcactgggttccataacagagagtgacaagaattatttgtctggcttgtttaaagttatttgtcttcaggccgggggcggtggctcacgcctgtaatcccagcactttgggaggccgaggcgggcggatcacgaggtcagaagatcgagaccatcctggcgagcactgtgaaatcccgtctctactaaaaatacaaaaaaaattagccgggagtagtggcgggcacctgtagtcccagctactcgggaggctgaggcaggagaatggtatgaacccggggggcggagcttgcagtgagcggagatggcgccactgcactccagcctgggtgacagagcgagactccatcccaaaaaaaaaaaagttatttgtcttcagagctcatgtccccttctgcttgttagatggtggcctcttctagggcaggaagtatgtctttatctctgtttcctttcaagtatctatacatttctctttccaacatttattgtgcacccttactgttcttaatactgtactgagtactggatacacatgaaaaaacacagtctctgactcagtctggtggcaaaacagatctctaaaccaatagctgcaatttaataaagagtgttctaatatccaataaaagtacgctcagagtgttgtaagaacatagcagatagcacaatgtcatgtcatgcacattgcaggtgcttaatatccatttgtccaatttaatttactcaaagagaagaagagcttagctcaatagaagggaactatgacctacgtgatagatcaaggccacgacaagtatctaaaaccaactctctctcagttcaagttcctttatgtctcacacttaattccccaaattaagaccagcatacacagagtgttccagctattaaaatgcagaacccaattttctatccttaaatgtttttactccaggatttcactctgcaagtgtaatattgtattatcatatgtcccagaaataagttgtaagtgggttggaactgacaacagtgatagaagtgatggaacccaaactttcctgttaataccggttaaagtttcagagttagagagggtgtgggcaggggatgtttaccatgggtagatgaaaactgacaagatagaagatatatgcagttaagagcctctgaaaacagggaatagacagttgtgtaatgctggctggctggaaatagaaagtaaataactggtgttgccagcacaagtaaacagcaaacaggaataagtcatcagtgagcatttgatgaaaaccagttatggaagtagattaggggttattttgaatagttattaggaaaaatgtctgggtgaggtaccaatgggaaaagaaaagatctggaatcactgcaggaaaaaagaactggacacgcatgtgatctttttatctccgctctctgcctccctctgtacccgctctgtgctcatgtttctttcctttattgccctgatccttctctttgcgtcataatttccatcaaacaagtatttattagtgcctcctatgaacggaacattgtgccatataaggagataaatgatacagggttcctgccctcaaagaactaacagtctagagaggcagataaatatgtactttttatatggaattaactacaatttaatgatgaaagtggcatgtgctctaacagaggggaaaagaaaaacaaaatactgtgaaagaacattggtgaaagatattaattctgactcgggagaagggcatcttgaggagattaagcaaagacaaagaatggctagaattttaatagaataaaggtaggtagtcattcttgtcagagggatttgagaaaagtcataaaacgtggcatgtttgaggaatggtgggaatggaatatgtagggagaacaatgcatcctagcttgccagggatttcccaggttttagcactgaaagtgctgtatcctggaaaacttcttagtcctgtgcaaacagggatgattggtcaccctaaatatgcatgggacattgggcatatgcatcatagggagtaaaaaaaatgaagggaaaaccaaagatcagtgaagacaacccataggaaattaggttgaagacaggacatgaagagtaccaaatgtcaggctaagaagtcatgacttgtttttacaggcagttgacaatgaaacagaggttttggataggggagtagtataatgaaaacataagattactctggcaaaaatgtccagggcagatgaaaggggtaaaaaactagtttggagcctattttgaaaatccttgcaaaagacacacagaagactttgacaaggaaatctacaatgggaatggagcagaggagccatagcgaagagacagtgcagtggcaaaaatcactgaaccttactgactaatatgggaaattgtagaaaggagggatgatgacaatgttttccaacctggtttattgggaaaattgaggtgccattagcaggaatagggaagtagcaatgatagttttaaatggaatggtgacaagtttattttaatttagtttccaacaatctggggttgggaagccaaataaacacgtgattcatgagctaaagaagatgtctgacctctagttataagctttgggagacatgagtataagaattagactcagatataagtttaattatatatgagaggtcagatatgaccatctatggaaagagtaaagttacagaaattagtaagaaatacatggtggtcattagagcctgttacaggtactccagttctcacctccttccaggtacataacaacattgccatgtgattgcttttgccaactaaatgtcagtaaaagtgacttattcacatccaggcaaaagcttgaagaagccatacagaattcactgtgcttcttttatcctgcttcagcaatcattaaagcaggtgtcaagaagaatcccctattcagtctgggtccttgggtcacttcaatgagcggagacaaatgtcattactatgtagcatgagcaagaattaaacctttgttgtttcaagcccctcaaagtttaggggctgtttgttgctatagagtaagctagcttatcttgaatgccactgaaaacttagaaatacatacatttagaagttagaagaaagagggaactgacaagtgactctttcatggggatggcgcagaagagccatactgaagagagagtgcagtagcaaaagtcactgaaccttggtgattttacagtaaagtatacaatttacagtaaaagaataagcagaggtgagaagtacataaagcgaaaatgaatcttagaagacaaaagaagaaaaatattcaagaagtgaaggtagtaagtagtgttagatgaaatgaatcaaagactgaaaaagaacattggatttggtcattagtagtacattgggttactttctaataagttcagttgtgtgacagaaacaagcaagggattgagaagttaacagggagtgtgtaaatggagttaattaatgagggtaatcatttttagaaatttggtaaagagagaaaattccttaagcaatgtcctaccttccgttggataagcatggttttttctctctctttccatctctttgcttactctgcttcctccatattatcctggttctcttcttctagatctgcctcttctctgtcctgccttctctatgcccctgtgtctctttgcctctttttccctatgatggcatgataactcttacagctggacagagtgggcctagttcagcctgtggtccaatacaggagactcctctattttactgctgatcagactgaaattaaatgttgtatcactgaaggagttagctcactaattcatggaactgcctatcccgtaattgtcagataaatctagctatctagacagaaaacttgtctcctactcagctgaactctgcctccctttaactttttctcagtcctaattctacgctccctataccacaccagaaatgttactctcttttgtaccttgtacttgatattcatgctctcttttctctttgcccattccttatcctcacctttccattgtctcagagatgaccctcaactataaagaaaatattaattttcttattaatagcctcagtttcatcaagtggttgaataaatgggccttctaaaaatatacataatttagatatagatatatagatatacttttatgaagaacactaaatttgtaacattgcaaacaacttacgttaaagtgtattttcaactattctgtgtatgtgtgtgtgtgtgtgcagtgagtcatataaagaagtgctagccttcttgttttgaaaaaagaagaatttttaagtttgcaaggaaagagttagattgagtattttaaaatcatcatattcttttcttcacaaacaaaacaattaagtttttaacttttttttacttatatatgtccactgacttatatgtgggagttgggtcagttatgctcagtagtaaaaagcttcttatacctaatttagataacttctagaatgataaatccatatggctcaattaagaaaataaaggagcttggcggacatcactcagccatgcaccctcttaaactttcctttgtatttctgtccaacactgaatccttagcttgaataggctattgcaatgctcttatgagggcttattgtcaagaatacagagatggtgggaaatcagttccaatgcttaaaaacactgtttataaagcacttctctgactgaatgtttttcccagctttggagagtaaggaaaggtgtaaaaatgcaactactgaattcctaggctcccttacaccttaaagagaggcaacaagcttgacttcggtgaaatcttagttgtattccttcttccagaaacaacagtcttgtgtttgcatatctttataattttcacagcatttccccgaccattatcttgttggaatttcacaattctatgaagtaagaaaggcacgtagttttccttattctatagattacgaaactgctgctcccttgggccacatagcaagcaaatggttaatccaaaactaaaatgtccttactcattactcattcctatgattcacactggttctttgaataataattcagttacatggtagtatagttatgcttggcaaggattgcatgtgattccacaaaaagcaagacccttagatggcacagagctgcccttggcacatccctgactcctcttcctggtcacatccctttctaagttccttgagttttatgactagatctttggtttctgctgtatctcttaccttcttgtgccaaagaaactgttctctaaaaacagcagatgctcaagacctgaagtacaactggaagcaaaataattttgattttgttacctaggcaaagacaagggaaatgttctgtttagaatttgagttacttgcccttgtatctaacagcttataacatcattctgggccaagtaaatgccttggcaggtgtggaaatttctttgaagagctctacctcacctgaatctcttattatcgatatggaatcaggtatagtcacgcaaacaaatctcgattttaaaatgccccttttaatacaaagagtctgtaggagggtatggtcctaccttttcaagtatgactattatgagtaagaggaggagctaaaaacaaggtctctttgacaataaagttttccctaaccacaactatgagaagattcaaaggaatacagttagactagcataaaacatgtcttcctttcctgccctggtgaagttcccccttatcattcagccctgaactttctccagtcccatcttaggattacatcacatttgtcatacctttccttttatctttatagaaaggatgatgatttcctcagatgaagaaaatgatacaaatatgatggaatttattctggtaggactgtccagacagcctgcatctcagctactcttcttttaggcaatattgttcatctactctgtcaccctggttggtaatattctcatcattgttattatccagattgattcccatcttcaaacccccatgtacttctttctcatacaagtatccttcttagatatctgctccacacccacggttctggtgaactgctagaaggactttccaagtgtatcctatagtggctgcttattctaaatgactatctttctttacttaggggtgacggagtgtgttttttttttgttctgttttgttttgttttttgagtcggagtctcactctgtcacttaggctggagtgcaatggcacaatcttggctccctgcaacctccacctcctgggttcaaacagttcgcctgcctcagcctcccgagtagctgggattacaggtgcccgccaccatgaccagctaatttttgtatttttagtagagacggggtttcaccatattggtcaggctggtcttgaactcctgacctcatgatccgcctgccttagcctcccaaagtgttgggattacaggtgtgagccaccatgcccagccgagtgttttcttattgctgttatggcctatgacaggtttgttgccatctcaaaacccttgtgttacccattcattatcaatagcaatgtttgcatctggatggtggcaggagtttgggcccatcctggtcgcaccaatccaattctgtggccacaatgtagtcaacattttacatgtgagctccaagtaattttcaaactcacttgctctcctgtactagtcaaagagatccagtgattcatgattccaggttgtacattataggcattgtatcagcattaagtgtgctcctacagttaagctcgccagcaaacccatcccaggagctgagaggcatacaattagggcataaggtgaggtattatcggggtacacttacacaaagtatgttgaaactcacacagccaattgccataatgaccattgaattagcacataggtaaagctgagatgtgcaaacagatacctaatacatttccagcacctgaagatggtcttttgtccttgtgccagatccacccaaatgtctaggtattctaagtcttttccttttattgcttctatctgacatctttaatgagcccatgtcaagacatatcaaatatctatatgtcatggggatggctggttacaaatgaaaaaacatatggaaaaatatttcaacagaggggaaaagcagtatgaaaaaaagcaagttggaaacagaaactcaggccctacatactgaggtagaaccacctttttggatggtatcacgtttttatcaaggaggtacctggcagccagaaataaatagcccattttataagcctgaatgacttccaggatgtggagaactgtagaaaagagttttgcaaagacaactatataagctggtgctggtaaaatttttactagttcatgttgaaatgaaaagaaatgaaggtaaagtaatgaactgttcatagtttaattcaatcacaaagagtattctaaggtaattcaatgaaacactatttgcagtatcaaaaggttggaaataatggaaatgcctattaataagtgactgtttaaataaatttgatatatccgttcaacaaactactatacagctgtaaaaagatttaaaaagctcttcatgcactgacatgaaacgcttttcaagataacctttttggaaaaaatgtgaacggaatgctacacacatacatacactcctccacacagacagacttatttacttatttatacatagaatatctttggaagaatgcccaaggaacaaataacagtggctgcctgcagaaagggaaactgggtgttgaaggggcagggtaagagggagccttttaattgtcaattcttttttgtttttattgatacataatattcgtagatatttatggagtacatgtgatattttggacatgcatagaatgtgtaatggtcaagtcaaggtatttaggatatccatcaccttgaatatttatcattactatgtgttgggaatatttcaagtcctctcttctaactattctttatggttttgtacattttgaattttgattaggaattgttctttccttctaatttgttgcctaatttttgccttaaaatagtattttaaaagaaataatagggttaatacattgtagatattttgttatttcatttttaattctgtatatatttacatagcaaaatgaaaagttggtgtattagtctactctcatgttgctaataaagatatacccaagactgggtaatttataaaggaaagaggtttaattgattcaaaattccatatggctggggagacctcacaatcatggtgaaagacaaaggaggagcaaaggcatgtcttacatggtggcaggcaaagagaccatgtgcaggggaactccccttcataaaaccactagatctcatgagacttattcacaatcatgagaacagcatgggagaaacccacccccatgattcaattgcctcccactgggtccctcccacaacacatggaaattatgggagctacaattcaagatgaaatttgggtgggaacacagccaaactatgtcagctgacaaactcacttaaaaaaataggtacacatacgtaaaatccaaaatgttggaaccactgctttaaggtcccttctctggaattcaacaaccagtctgtctcattgctgttcccctctgaccttgtgtcccagtcctgaaccagtgtctctgccttagacacctgcttagtatcccactccctcaaggaatcagacctcactatgctattgtcactcaatgtccttcaccatcaccaccacccatggattagcatcctatccctgaaatgggaaaatgtgatgggggcccttctaccagctgctggacctccctgctggacacaacttgattcatttgctggagtggaatgctaagaagagattgcatccctgccaaattcatgttaaagcccaaatctccagtgggatggtatttggaggtggaggcttggaaggtaattaggtttagatgaggtcatgtgggtgagggctcccttatgggattaatgaccttatacaaagagaaagagacataagatttccctctgtatgtgtgcatccaccaaggaaggccaagtgaagacacaaccaggaataaggccttcaccagcatgcaatcatactggcacttatatcttgaacttccagcttccagcacagcaggaattaaatttctgtcttttaagacaatcattctaggatattttttataacaccctgagttaagatagtttactttctttttatgcttaaggaagtaggattttctttttttgtatgtcttttcccacccaggtttattgaggtataattgacaaataaaaatatatatattagggtgtacaaagtgatgttttgatatatgtgtatactgtgaaatggttaccacatcaagctaattaacatatccatcaccttatatggctactttttttgtggtgagagcacttgagatctactcccgtggcaaactttaagtatacaatacagtgttattaactatagttaccatgatgtacattagatcccccaaaattactcatttcacaactgaagatttataccctttgaccaacaacgcccctcttacccaccccttagctcctggtaaccaccattctactctccatttctatcacttcaactattttcaagatggcgcatataagtgagatcatgcagtatttgcctttctgtgtctggcttagttcacttagcataatatccttcaagctcatctatattgtcacaaatggcaagatttcctcctttttgaaggctgaataatactccattgtgtaaagatatatatatacatgtatgtatatatatacacacatatgtatagatatatatctgtgtgtgtatgtgtatacatatatatatatatatagtgtgtatatatacatatacacacaaacaccacattttctttttccattcgtctcttgatggacacttaggttgtttctatatattgattactgtgaatagggctgcaatatgcttgggaatgcagataattcttcagataatgattttatttcctttggatatatactaagtagtggaattgctggataatatagtagttctattttgaatttttaaaggaatctccatactattttccataatggctgtgccactttacagtctcactaactttgtacaagtgtttccttttctccatatccttgccaatacttgctatcttttggctttttggtaatagctatcctagcaggtgtcaggtgatatctcattgtgattttgaattgtatttctttgataattagtaatcttgagcaccttttcatatacctcttgtccatttgtatatcttctttggaaaactttctactcagatcttttgtccatttttaaattgggttgtttccttgctattgagttgtatgagttccttatatagtttgaatattaacccctttcagatatatgtcttactaatattttcttccattctgtagcatgcctcttcattttgttaatcaacaaaattttttcttttacaacttttgttttggatttgggagtacatgtgcagattcgttataaaggtatattgcatgatgctgaggtttggggtttgactgaacccatcacccagatagtgagcatagtacccaataggtacttttttcagcccttgcccgcattcttctctcccacctctaatagcccccagtgtctaatgttcccatctttatgtccatgtgtatccaatgtttagttcccacttacaagtgagaacatgcagtatctggttttttgtttctgtgtcaattcacttaagataatggcctccagctgcatctatattgctgcaaagagcatgatttcatgtttttttatggctgcatagtattccattgtgtttttctttatccagcctaccattgatgaatacctgggttgattctttgtctttgctattgtgaatagtgctgcgagaagcatacaggtacatatgtccttttgatagaacaatttattgtcctttgggtatgtattagtctgttttcacactgctataaggaactacctgagactgggtaatttataaagaaaagagttgtaattgactcacagttctgcatagctagggaagcctcaggaaacttacaatcatggtggaaggtaaaggagaagcaagcaccttcttcacaagatggcagaatagagatagtgtgcaggggaagctgccacttataaaccatcagatctcatgagaactccctcactatcataagaacacatggagactgcctccatgatccaatcacctcccactaagtcccttccttgacatgtggggatttcaattcgagatgagatttggatggggtcacaggaccaaaccttatcaaggtatatacccagtaccattactgggtactcgtgctgggattgcttggtcaaatgatagttcaccacttagttctttgataaatgatatttcaccacttagttctttgataaatcaccaaactgctgtccatagtggctgaactaatttatattcccactaacagtgtataagtgtccccttttctccaaagcctcgccagcatctgttattttttttgcttttaaatagtaaccattctaactggtgtgagttgctatctcactgtggttttgatgtgaatttctctgatgatcagtgatgatgagcattttttcatacatttgatagcgacttatatttcttcttttgagaagtacctattcacatcctttacacactttttaatggggttatttgttttttgttcattgatttaggtttcctatagattctggatattagacctttgtcagatacctaatttgtaaatattttcttttattctatatgttgtctgtttattcctttgatagtttttcttgctgtacacaaactctttagtttaattaggtcccacttatcaatttttgtttttgttccagttgcaattgcttttaaggacttagtcataaattatttcctaaggctgatgtccagaatgttatttcccagatttttttctaggattcttatagtttgaggtttacatttaagttatcaatccatctcaagttaatttttgcttgtggtactagataggggcccaggttcattcttctgcatatggataaccagttatcccagcaccatttattgaatagggaatcattgccccattgcttatttttgtcaggtttgtcaaagttcaggtggttgtggatgtatggctttatttctgggttctctattctgttccattggtctatgtgtcagtttttcccccagcaccattctgttttggttactatagccttgtcatacagtttgaagttgggaaatagctatttggggacttttggggttacataaattttagcacttttttttttttttttttttttttggagatggagtctcgctctgtcgcccaggctagagtgcagtggcatgatctcggctcactgcaaactccacttcctgggttcaagtgattcacctgtctaagcctcctgagtaactgggattataggcgcccgccactgcgcctggctaatttttgtatttttagtagagatggggtttcaccatgttggccaggctgatctcgaattcctgacttcatgatccacccacctcgacctcccaaagtgctgggattacaggcgtgagccaccatgcctggccagcatttttatatctctatgaaaaattctattggaatcttgataagaatattaatttttcaatctatgaacacagaatagctttccatttattttgggtctcctacaatttctttaatctatttttttttttagttttcatcttcacctccatggttacatttattcctaagtattttattgttcttgatgctattgtaagtgggatcatttttggatagtttgttgttagtgtatagaaacacagttgattgttgcatgttaacaaaattcaatatcctttcatgataaaaaaaataataaaactcttaacaaagtgagtataaaaggaatgtacctaaacataataagagccatctatggcaagcctgcagctaacatactgaatggtgaaaagctaaaagcttttcttctaagaacagaagcaaaacaaggatgcccattcttaccccatctattaaacatagaactggaagtcctagacagatcaacttggcaaaataaaaggaataaaagccatccaaaccagaaatgaagaagtaaaattggcaccgtagccagggtgacagagagagaccctgtctctaaaaatatttttaaataaataaataaaaataaaaataaagttgtacaagcatctctatcattttaaaaaagggagtgaaactgtctatgtttgcaaataacataatcttatatattgaaaactctaaagattccaccccaaaattaataaattcagtaaagttatggaatacaaaattaacattctttcttccagctttatttatttatttatttattttttgagacagagtctcgctctgttgcccagactggagtgcagtggagcgatcttggctcactgcaagctccacctcccgggttcacgccattctcctgcctcagcctcccgagtagctgggactacaggtgcccgccaccatgccaggctaattttttgtatttttagtagagacgaggtttcaccgtgttagccaagaaggtctcaatctcctgacctcgtgtctgcccgcctaggtctcccaaagtgctgggattacaggcgtgagccaccatgcccggcctcttccagctttattgaagtataattggtaaacaaaaactgcacataatgagtgtatacaactgactgagttaatatctatatatatgtatatagatatatatacacataaacatatacatatacatatattcatgttatcatcactacaatcaaggcaataaacatatctttacctccaaaagtttccttctgttccctttttgttgttacttgcttgtttttgttaagaacatttcacatgagatctcccctattcacaaaatatcaagtgcacaataccttattgttaattataggcactatattatacagcagatctctggaacttattctgtataactgaaactttacgcccatgaaaaaatagctctcaggctggacacggtggcttacaactgcaatctcagtgctttgggaggctgaggagagagaatcacttgaggtcagggttcaagaccagcctggccaacatggcaaaaccccgtctctattaaaatacaaaaattagccaggcatggtggcacatgactgtaatcccagctacttaggaggctgaggcatgagaatcacttgaacctgggaggtagacgttgcagtgagctgagatcgtgccactgcactccagcctgggcaagagagcaagaccttgtctcaaaaaaacaaaaacaaacaaacaaaaaaacagaaacttccctctgttccctctcccccttgcctggtaaccaccattctattgtctacttttacctgtttgactattttagatgccttatataagagaaatcttgcagtatttgtccttctgtgactgactcgcttcacttagcatcatgtcttccaggttcatatatgttgtttgaaatggtagaatttccttcatttttaaggctaaatagtgttccactgtgtgtgtatatatatatatatatatatatatatatatatatatatatacacacacacacacacacatacacatatatatacacacacaatatgtatacacacatatataactttttttgtctgtagtatatataaagaaaatgcaataaaatattatactacatataaagaaaatatgatactttattacattttcttttttaaaataattttactttaagttctgggatatatgtgctgaacgtgcaggtttgtaacataggtatacatggttatacatgccacggtagtttgctgcacctatgaacccgtcatctaggttttaggccccacatgcattaggtatttgtcctaatcctctccctcccctttccccctattccctgacaggccctggggtgtgatgttcccctccctgtgtccatgtgttctcattgttcgccaatattctacattttctttatctatttatctgttgatggacatttgggctgtttccatatctcggctgttgtgaataatactgcaatagatatgagaatgtagatatctctttgcaatcctgttatcagttcttttaaatatatacccagaagtggaattcctggatcataaatacagtagttctatttttaatttcttgaggaacttctatactgctttccataatagctgcaccattttacattcctaccaacagtgtgcaagggttcacttttattcatatcctcaccaacacttactatcttttgttttcctttctaatagccattctaacagatgtgagatgatattgtgatgttgatttgctttttcctgatgattagcaatgttaagcatcttttcatatactgtcagtcaggtactggcacaaaaataggcatatagaccaatgaaacagaatggagagcctggaaataaacacacacatataaggacaactaatctttgaaaagagtactaagtatatgcaatagggaaaatttgtgtcttttcaaaaaatggtgttgggaaaagtggctatcccattcaaaaaataaaattggtctcttatcttataccatacacaaaaattagctcaaaatggattaaggacttaagtgtaagatattttaactctaaaatagttagaagaaaacatagggaaaacgcttcttgacgttggtcttgtctatagtttcttagatatgacaccaaaagcagagacaacaaaggcaaaaatagacaagtggaactacatcaaactaaaaagcttctttactgggaagaaacgaaaggcaacagaatgaacagaatgaaaggcaacctacggtatggaagaagtatttacaaaccatatatctgataagggtttaatttccaaaatatataaggaacttctacaacgcaatagctaaaaaaacaaaataactggattttttaaatgtctgagagatttgaacagacgtttctccaaagagagtttactttctaaagtttactcattcctgcatttttctttacttttctgtaagtgcctgtgaagctttccttgccaactcatacttatttggtccctctgatgtccagggtttgcattagaaaacctcccttaaaatatcatgttctgcttgccagattggaagtcagcccaaggatcttcaagacgattcttcttttcagctcttctttacaccaaatggcccatattgagattatgtcctgtggcagagattgcttgttatctaccccattatccattttctcgatcttctttggtaacaaatcactgaattttattcaggtggtaacatatctagctaaaagaatacaattttcagcctctcttgaggctaggtgtgttcagtgactaaattagtattaaaatataagtcaaaatattatgagaaatttctagaatgtcttaaatagaagcaaatcagtccccccaccaccaccccttattttcccctttctctatcctgatgcctagaatgcaaatgcaaaaaggacatgtatctatctgaaatgttcatagaaaacatatctggaactctaccatccttcttgttctatgagaataagggcagaatagttaactggaaataatgtgagtctgtgaatatcagagaattatcatagctgttctacacttctcatcttcagttaagtgatgtacaaaaatcatccatcttgtttaagccacaattatactaggttttctgtcccttacagctgaacttgattctaactgatatatcttacctgttatgtttccatgtcccattgaaggtgactaagccatgccccacagtgtttcaacacccgacatatctgagtaataacacctccctacatatgtaagggacatcagtatgaatagaattttaaaccctgctcctactgttgattcttttgctgcctacataccaatttattgttattattttgtatacttggtgatgattgctttacagttgatttaattctcactccaaaccatgaggggagaggaagtcccatggcatgagtgagacatgctgctctaagacaatcaaaagagaagacgttggacatgccgagttcaaactcatgaaactgtcaaatcttatttagagtaatgacaaccaaagttctatctacagctcagacatctcttctgagttccaattacatgtgtttgtgtaaaaagtacatgtatctatctgaaatgttcatagaaaacatagattgagatattctgaaacagaaagcttcatcttcatcctaaaatctcctcttcctcctgtttattgcatcaaatggagccaccatccaccttgaagacatcccctaatcctcttgttcccttactgcaacttccaatcatcctccaggctttgcctatcctatttctgtgataaatctcatccatccctagactctcatcccactgcctctcccttaactctggccctcatcatttcttgctctgaccactgcagtgacttgagatctggtatccttagcaacacagtctaacacaggcttcacattacggtgccacccacttttatgagacatgtcagagcatgtcactcccttgtttaaaagttcttcatgatgtccagtcatgaaggcaaaaagttcaactcttcaatgtgacatttaagaccttccaagatctggacccagcctatatggcttttctgactcttgctgattcagcaatacaaacttattaacattcccattaacatctccttcatttccaattctgagcacaggattgatgtggtgtctgtaaaatgcatgtggttctcaactagttaatccaacccaggaaacccagcaagaatgtttctaatatgagcctccttcgaccatcttttatctctgggcctaaagagtaagtccctcctttatcaatgtccccctgcacaagtttatatgtgcctcctttgtacatcccttatactttgtacatggctgtacaatgtaatatttcatgcagctaaacatcttggaaagcaagtgagagcggcatccatctggaacagcactagggtatatccatgctgctgtgtgaatttctccacatgtttgcatagatgtagcgccttcagaagtcaacagacctgctaccatcaaaaagaattcaacctttatgctcatgctcttttcattctactaacttcagggatgttctacatccccaaaaccccagcagcccctttgcctcctcttcatgcctggtatcacccaagctttgtgcctagactttctagcaggacccaggctgttctttctggacgtccctctaaaccagtgactttgtctctgaagatataaaatgagtttgagcagccaggcccctcaacataactgaccattcccaactactgaggacaccctgtccacctttgcttggcctgaatactctcatgtagctagaacctactcattgtagctaaattcaagatatcagaggaaatattatctggaatttcttgtcttcgtttttttttttcttttagaaaatataatatctctgtctggtagccctgcttccctcaaagcttacagtgaactgaaataaatgcagggaagtggtcctatattctgtacacttaagaaatgggaaattcaatatttgtttacaataacggcaaagttaaaatagctcatgctacattgccaaatgaagaatagcagagacataaacactgtccttaaaaagatttttttagaagaaaagtatgaatcgaatcatttactgaagtactgtttgaacagatggtgtgattaacagctaacatgtaagccatcttgggagtttatggaaaagtaaacacgtgcagctaaaaagaaatcactttattccccaaaaggttctttcattcattttactaagtaaattggaaagcctgggttttgaaggctgcatttccttgggggatgttaggaaggagcagaggagagtctcttcagagcaagaccatgtcgatgcagggtcgagctccaaactcgcctcctgagggatgaaatgatctgaggacctggcccctcccgtcagctggcccttgacaacaactgaagatgctctgttcagcttgctcatctccagtggcttcacgtgcctgagaggaggggaaaggagttaaggtttgggaatcagttcctggccctctgctgggcactttgcatggactgtttcctctaacgctaacatccctgggggtcacgtgttataaggccaacttacccaatagggaaaatggggtttaaaaaggaggaagtggcctgccaaggctgtatagatacttccttcatggagctgccattgaaaccctggcctgttgagtgggttgtcaaggagagtgtggaacaggatatcaggggacatgggtatgaaagtctgctctgctagcgtgtgctttggggaaaactgctgttcccttatgcaccacagcttctacatctgtaacatgtgggtgccataccggatggccttaaaggtcctcatttggatacagaaatggcatcaggatattaagttggcttccagccccattcctgatcatcctcaactgacattaggaatacatccttggacacttctgtagctgaagccatggtgccacctacttaggcaaacctctgaaggactggctgatccttggcagagctttcttgccactgcctacaccacagcacaccccaattggtaatggctcatccccaaattgccctggtgttcatttattcacctaatatttattgagtgtgcactaacactccaggcaaggaagtgtggaaacattgtgagcaagagggatttggtgtctctccttccaaaattagacccagtaaggagacacagaagtgaacagataattgaaatatagagggataaatgtgagtataagaaaagggaacttgacctctacctgtggaatcaaggtatgctaccttgttgatggtagtgatgatgacaccaaactaattttttagtggattttttcttttccccttctttttcttagatctacctcatttgtcatataccaaactaaacaatttttatcaaacatctagatatttagaatgatccagttgaccgttatagatttgcttgcctttcattctgatattggtactacttagatgcccatgttggtttcccaggccatttagagtcaaaagttgccaggaaggcaatgaaatcacttatgtttccaaagatagagtggcttaattaaagaggaaagcaaattttcatgttaataatctagaaataaagcccttctcttggacacgtccctgtaaatgcttctgagctctttcatgtgaagggccttctaattgcttctctgggacttagtcctggaagctttgaaagggtttcccattgcaatattagaaccactgatactgtgtcccctagcaggtgtgattccacttccttttgtgtgcatgtgtgtgtgttattattattatttctttttttttacaaaatcaactttgagaatattctccccatttagtaaagggaatgcaccttttgagttacatttgaatttcactccaggtctctactaaatggaatgaaaaagcctactgtgcattctgtgctgatatgtgacagtcttcagagaaaggactcctttcttagatggcatgacccattaaatattgctccaggtcaacagaagaaggaaattgctgtcccgcctcaggtacccatctgctataacccttggccctttgcacctcactttatagccacttgaatctaagtgtcatcctcaccagtcctatcctactgtgtgttcctgcagataacaatagtgtcttgggcttcctgagatgccacttgctaaaggccaatgccttatacttagtaggtgctcattccatatttggccaatgtcaaaactttcaacattgctttattgagctctcgatactgttttattggcatgtaaagcctgtcataattcatcttcgaaggcagtcatcttcattcctttccacatggcaccaatgtcatttcattaatttaccaggtggtaaaaacatactcaaaaccattcattctgaggatcttttagatttttaaatctttatatttgttcacctccaataatatgtcatgaaagctaatttctggccttacagaccgtatgctactcctaggggagagaaaaatggcaaaataagtccttcaattcaccatgctggacttttccttggacaataatctaataaaagaacaacaaatgtcaataaaggattgtaatattttttctaagtctataattatttacttgcacagttgttctatttcgttttcactgaaagctttatcttaaattgtttatttgttaaaaaataaaatattgttcatcatgagttttgatagtctctgtatattgaccgtgggaaaccaaacatacttgaaatcatagagcttagaagagtcattaaagattttctgttgccatggaaaaacgcttgagtgggaaagcaggtcacagcattctctataaagtgacataatgactgcagaaataagcataagaatgggaaaagaacccaaatattgtttatggtcatggctaacgagtggcattctgtttggcttcgcttccattactaacagtttcccgtggcttccacgttttacttctgattgaaaaaaaaaaccatacatttaaaatagtaattgtctagtaagattcatttgcttcatagataagaaaacaaaagtccggagtgtgtgggaaaacgaggagcggaaatcttgcctcaggactctaagtctaacttgtactttgaattctgatttgggagagacattgatttataatttcatttgtcaattcatccaaaagtttgggtacaataagaatcctatgcattttaaaacctggcacacattctaaagttaagtgggaaactatggttgtacatgaacaagggatgtgttgactaagtttcttctttctttgagatggagtagccatttggactcatcgtcttgtggcaatgccccttgccctactccctagtgcctcctctcagtcatctcctcttcccaagtgcacattgccaatagtagcttcagtcatccagaaatgctcataacctctggtgcaaaaggaaattagactgctctggcaaatggctgtcactgtgtctgagtatgagttgttttcactaaaggaaacctgaactttttggtgctaattcctgctaattgctgacacctcataattaaattggcagaaatttcactccagggtcatggcatataaaaactggcaggcttctttaaagatgactttctcaaaggactctgagactggggactgtgggatcaacggaatgtttccaggacttcattctatgaagaattcaatgggcacagagggccacaagggaatgctgtttaaggtagggcataagacttgtggatacctaaggaactagggttcatagcggccagtagggcatggtggtctccaattattataatgcgaaatgcaaatacaaagtggtattcaggctcgggcatatgatttcaagaataatcaccatcccttctagatcagcatttgacaaactacaacatgaaggccaaatccagccccccactgcctgtttttacagataaagttttgttagagtacagccatacccattcattttcatgatctttatggctgtttttgtactacaagagcagagttcagtagttgtgacaaaaatcaatggtctgcaagagcaaaaatattcctgaatacggaaaaacttagcttaccctgtcctagatcataaaagagaaaagttagaagaaataatcctaaaaggaaacaagtataaaagaagaattaaagagactcccaatctatagtgtggaagcttagcaatgaaacagcttgaaatagagatgaacggatgggagaaaactgtattcctggaataaaataggcatgtgtgtggacagttctttaagggcggttatgaatcatctaaagctggtgttgacaaactacagcctcctggtcaaaactggcccaccatgtgtttttataaatgacattttatgggaatacaatcacacccatttgtttatgtatcttctatggctgtagcgttactacaaaaacctttaataacagaatgagacatttaactcttatggcctcaagtgccctcctcttttggtcttccccaacttgcaagacctctgaatcagctttgcaggctccttttctttctctaagatttgcttattgttctccacccattctggccacatttccagtcttattacccattatctgcaagagcaaatgggagaaactttacctggaggcagtattttggcccatgattacatgtcatatcccaaatcatgggtaaaacacaaacttggaattttaggacttggtatctgcttaaataaattcctcctaacatattgattaatggatcaatgttatgttggaagaatgtctccagtgacatacccagggccctgttctgtttaacatttttatcaaatgacttagataaaaagccagaaggcaaatttatcaaatttttgttaacacaaagaaagcaagaagcaataagtaaagtttgggataccagaattaacattcaaaaagacctcagtggactggagctctgagtcaaactgaacaagatgaagcattgcttggcaaatggtaaagctcagccttgaggttaaaagaaaatcaattgtgcagttactggaagtgaactaaatggtttgagagtagtttgtgtgcaaaattcaatgtcagtggccttacttccctgctaagtaaaatgctagtaaaaatagctgattatcctaaatggcttagtacaggagtaccgccacagtctgtctcaggagcagaactgggtttgtggttgagatatcttggaactatatcatctaaaatgaggtggaaagactatagcattcctagcatagagaaacatactctgactctgaggttaattttattcacgagtttcagtggtaatcccaaatcacatgcagagattgcaaggtttccccttacacatgacttattatgctaacactaggaaagtcctggacaaactaagacatttggtcacactacattatgcttcagccacacttaactcctatctattcagcaaacagtttcaacttgttcttgccttggggtccgagcacttgctgttccctctgcctgggaatatcttcccctagattttcacatggccgttgggacattttggtcccaactgaaatgccacctcccttgaaacctcacatttataataacgattttgtttcaccactatctttcaaattgctctgttttattttcttcataacagttcttactatctgaacttattttatttgttacttgttattatctttctcaccacattagaatataggttaaaaagaaaagttttacctcttttgctcattgctctaccctcagcaactaaaccagaactgaacacgtaataagaactcaataaatatttgttgaatggataaatgaaagtgaatgattctgcatggtatatattctgcatatatacaccaaagtgctctgaaaaaaaaaaaccataggataagtcaaatccagagagctggcaaactttcagatgaggtcgcacaggtcagtatgctacggggatgagtctagtgtacttttattacaagctgggaaagctgatgtcaattgggacttacgagattgctatgtaagtactgtctacacccaggagagcaaagtctgggccgtttgcatgctctgtgctgtggtcttgaagtgaaaaatgtctattttcatcttaaatttcttgaggctctctagctctggtcaaattatcatcagagttttaagaaatttcaaattagaatattgagagaaaaatatctatggcctcacagccaattttccttttagaaatattggccatacagtttctttctattatgaactcccagaagatgtggttattttctcccaacattccagtccattccatcataattaggtccatagcatcatttcccctcaatgcttctttaaccttctgagaaatgaaattgtcagcaaggcaaatcccaaatttatcagatgctctgcttttaacagaatgagacttccatcagatgcctggacagctaaatccttccattcctgctgtagcttccctctatgccagttctgtaatcttcattatggaagcatcaaccatgtcctctgtgaaatatttccttgattgcactgcaatttctccctatttgtatgctcctgcaaatgttcaccatcttattctcctttacattttgtgtgaattttcacggaggtttaatatgtttttaacatgcaggatgagatggtccctaggacagaaccagaaagaaagggcaaatcttagtaccaaccctctatggacagataaaaggagtgactcacaaaagtccaatgtgaactgactatctggctgaaagttctcttctgctgtctttcaacagaccattgctctatcagtcaacattttttgtactaaggaactgaagatttaaaatttcagaaaaaaatgttattcagagtccaatggtcaaaaacagtatgactgaatgtagcacaaaactacttgaatggaagaatccatttagtcaaagtgacatcaagaggatttatttcagcaagcatcttttaagagtttcttctgtgcaaggtagaataccagagaaaacagatgacctagatttgtttgcaaaaatcaggggcttacagcccccaaagtgtacacccagctttaagtttagttatatagggtctaaagtccctaaagttaacaaacaactaaataaaaattaaatgatgcccagtctctgttggactcacaatcatacttgggagagaacttgactgatcaacatagcatatcattcagaggacccagcagacacaaaaggtgtcacacagtcctactgtgatatataccttggtcttcaaaattcctcaatattaaatcttcatagtactacttgaacatttaacttgcaagaagaaaaaaaaatgaaagaatgaagaattgcccagacagaaggaagtctcactttcttcaccacaaccatgtttactgaccagaatcattgctatcaggaacattcactgaaattctcattaaccaatttggaaggaaaatgaactttattttaatgagctaaacatagcagatgtctcctccttctttgttttctctctctgtgtgtttatattgggagagttaattgcaaagcagggacatcctataagtccccaaagtggaaacttttcttcaagactgaggttatcaattcttaaaccaccacatgattatctacatttctaaacattgtcttactcttgcatttgaatcctggcttcttttaatgctgctgaagtatttttggtcttgtacttagactatactttggcaaacaccaacatttttaaaagatttcagtgtattcagaaaggatatctcctcaatttatttttctgtagctgggaacaaagtaacagaatttagaacactagaagaagaaatatcattttaatatttgtacaggcaaagaaaaactgcatgtcacgaactggcatctatattaatattatatatgcgagaaaatgaattttttattgtttcttggacaccaacctatcatggtcgccttattacatgccacctctgtgtaaataaaagaaaaggatatttaaacaagtagaaataattgtgcatgattcaccagcacagttaacttaagattttggagccttataaccacaactgataggaagatttattaccacagctgcttgtattaaacttcttttccttgcagttgaaggaatcaaatttcttcttggagattagtcatttgtgggggtgtcgccaactgcaaaatgcttctgttatgaatgaggtgcacttctctgttgctgtcctccagccctaagtcagtgagtaattttcatctctttatgtgtctttcccgcctactatcaggaacagattttaatgacttacacagtcaaactttctttagttgttgctcaaacctaaaacttaagattgtattgtttctggtaatgtgataacctcacaaggaaaggtaggatggaatgacattttggcacatgtttacaaaatgaagtccaaactgtagggaaggtctacatggggcatgaaagcaggagttaaggtatcttgggtggctataaatgtgccgggcacatttacttatttatttatttgtagaaattatcttatctaattcttggaacaatcctgcaagaggctgggtggtattcccatttcacatatgagaaaactgactttctcaagactgtgcaggttttagtggctaaaccaaaagttaagcttaggtccagctggcatccttgctttctttctgtatgtcaacagtttgccttttagttataaagttataaagaattacacaattatatacggcactaatataactatacaatatggtgagattgacgctgtgtctaaatacgaaaattctaaagccaacagacacttcaattggtcatatctttcactccctactaaaaccatgtaaaactgaaaaggctctgtcttttcttattgaaaaatcctggaaacatgcattcaaaatttgccttgtcccttttcacaattgctagtaactgttttccgcatgaaatccttttatctattaagatatccccatcaccctttaagctcttgttcgaaactatatggagatgataggatctgcacatagtaagcttctgtcagccgaagatagatgtcagaacaattgagcaaagagtaagatttcagcaaatccaccaattgtttggtttattgcatgtcaatttggctactggtatttttccattgaattgactagatggtttagctacatatacactttctaattcaccatatataggtggttctaatatgacatataaggggaaaagagggttgaaaagtaaagaagtatttcaagcattcaaaagtgtatccttgagtttaaatttaaaaattattattaaagaggtgaatcaacttaaataaagctggaaaacatttttattgggcagatgtagcttatttgcccttttttttggtcaagggtaaaatcaatcatgtagctaaacccctttatgagagtaataattctatttgactcaatgtcaatgtaagtacctctatttgggttttaacagtccattcaactaaatcagtctgtcctaggtcatataagtttctataagacagaaaagcaaagagaacatatatttccaccactggatacttgaacagttgaacctaacccagtaaaataaatggcatacagcaattaattagagctccagaacatgaactataacaggctactgagatgctcttcctcttctttcttcatgtagatgacattgttttgtctcttttcccaacacttgagacaagtaaatgggtggtctaaaaagagacaatgcctctgagatgactgaactcatccttgttggatttgcccaacaccctgaaatccagactgccttcttcttggaactactgtttttctactagtcacagcgtttgagaacatccttatcgttgctgtagtgagatgagattctcgacttcatactcctatgggatttttttttcctcagtaccttatcctcccttgaaatgtgttactccatcagctgggagctataagtcttggctcaatgcatcaaggacttccccaccatctcctataacagctgttctgttcagatgatcacacacctctttctggggatgacagtgtctcctccttgctggcatggcttacaacaggtttgttgaaatctcttatctcctccattacactattattatgagcaatcgggtctgtatacagttggccttgggaatctggacccatgccttcttagtagcagtcacactaatcattgcaattcctgctagttattatggacacaatgtcatcaaccattttaccttgagatccaggccctgctgaagctcgtctgctcagacacccttgtcagcctgattcagggtctggttatcagtgtgttcacactgcccctgcccttcacattcatcctcatctcctaattttgcatttttgttgtgctgtggaggctaggcgtgaagctttctccacctgtggatctcatctgactggagtcaccatattttatggggcagccatctgcatgtacttgaaacctcagtcaaagggaacccaggaagaggataaagttgtctcaaaactttatggagcagttactcccatgttaaatcccccaatttacattcagagaaataaggatataaaaggtgcacttagaaagttagccaaaggaaatgaaaaatcctaacagttctctttaaacgtctccaaagtgcaggaaaaacagtgaaaacttggcctattatttcaatttatatttctttaaagcaaacaacaaaattttagtgagcattctttccatggtccccactaggcattcattaacaatttaccataaatattatcacaaaatttaccataaatattaacactttgtcaagccccacattaagacctaaagccatgaatgtgcccaaagtagttcacagagagaataatggtagtaggtatgtggaggcaggcgcaacagccatagtagcctatcagggagagccctttctcttgggtataagccataagatttttgtaaccaaacatctttgtacttgccacacaaagtgggaaaaattcatatacaagacagtggttatacaaccacaatacagcatttgcctctcataacacattttataggtgtgtacaccaatttgaacctaatggacaaatggcccctcaattctcccatttaggtgataacattccatggcaagaagtgtcttttgtatgtaaaagcacttatcttttaataagtgcttttaaattatatttataatttcttattttaaagtaatcttctctcaaccaacattgtttctacaaatattaaatttccatcgtatcaatttcttataaaaatgtctatactgaagttgttattcttttgccttctcctgtttctctgtctcctcttccatgatatgctttagcgaccctctggccatttcaaccccccatttctcatacacatttatgagctttagtatttctgctcttcccaagagtcttcctgaccaagattgtgattatttttctcctttttctccatttaataagatgctatatgcactttctgttataggcaggcaacatttattatatactttgtgtcataataacttgttattctttttctcatcttaactttgaccaactgactctaaaattctgccatagcacattcagaaggtggatatatatgtcttcttacttctaaaaccttctttcctcccatgacttttcttgggtagatggctttctggtcacaatattttctatccttggcttttttatttactttctttctgaggattgatcctttctgggttcttaaaaataccttacaaaattgtctcttcccataagttttctgccattatcatgggcaaatggagtgtgatgcttactccttgattgctgtgatttgctgccagagatcaagaggcaaattcattgggaagaacaattgtccattgattctgcctgacgctccttcattagggattttcttctgaatcagtttttctaggttttaagagggccaggaaaaagtccctgtcagttccacactgcactttgtttgtggtaccatgtatatataatcagaatatacatgcttggatggtgggcaaaggaatcagaaaacttgagtttgaattcgagctccacatttactagctgttccattacagcttaggcaagttacttaattgctctgtgcatcactttccccatccacaaaataaaaatagtaatagtattcctcttatagtgttgctggaaggattaaatttatggttcatgtaaggcccttataacagcccttggcacagggtagtcattcaataaatgttagatacaattgctattttctatatttcatccaaatgctcctgttcttttttttctaaagtctatttcctttatgaatctttccctccagacttcccaatgaggagctttgctagcccattctctaattttagaaacactgtaatatcatatttccctttggctttcatttttatggctttgctcttaatctgggtgactcctattccagttcctctgacctatgcttgatatattttaagtagagacagccccaaacttaggaatgagttatgtccaaaagctaactcataagtcatcagcttggaactcagagcacgttttctctactgagatagggtggctacattccaagggcagctcaccaacacctatttaggtcatcactttatcattaataatactaaaagtcctaggaccatactttttaaagtatgtttattggaagataggtgttgagtcgcaatgtagcattctaaaaacactgacactgttagatgggatttctgatccccaaaaaatattccatgagggtctctgccaccacactcatgtcctagcgggtatatgaggaattctcacagcaagttataagagtgggacttagagagcttctctagagactatgaaaataataactcacttctgtgtataagtcattcacaagtcagaggacttctgatcctctcttcatttctttttatgctatttattacttgtttgggatgacttgataacactgtacctcgggccaatcattccacaaacatttactacgtgtctactatgtgttagggatgcaaatccaaataagacattttttacctttgagatgatcacattggagctgggaagcaaatatgcaccagtgaagaactacagatactgtgatccacattatttatgaggtacaggcaccagctataactgggccagtcaagaaatatttaatattttagcagtcttgagagagagtttgccagttggataagggaggacaattttagtggacataatgtgaacaagtacagaggtacgaaacccagcttggtgtactttcagatactgccaacaattcaacattactgcagcagaaggtgtgggaagtgtttctggcaatatgtacgacctgagaaaaaatcagtaagccaaattagggggagacttgttattctctattaaagagcttgcactttcttcatcctagagatcaacaaattacagcctgaagggccaaatccagcccttggcttgtacagcccatgagctaagaatggtttgcaaatttctaatggatgtaaaaaaggcaaagaaaaatgtttttacaaagactgtatgtgtcatacaaatccagaaatctttactatctggccctttacagaaaaaaaaattgcagactcgtgcagtaagtaagtggtgggtaatcactgaaggttttgagcaagtcagtaaaatgttcagaattgtgctttagaaagttcactttcacaacaaatgtgaacaattgattgaagagatgtaagactggacatagggtaatatgattcgagcaataatctgagagctgatgtggacctgaactgtgctatagcaatagagatttggaaaagacctgtatcatagagtaccccttccttttttatttttacatgcaatttcatgcacattccagatacgttttctcaaaagcagcacagatataataaggagcttcagggataaggcaatctcaccttcaacatcactcatttctttcctaaaactaaatgagcacagagagatatggagggggatagggtctaaaggcacatagctgtgttttattcacatagtgcagccccttttctattccagaatagctctgcatgagttataaaattgcatttggttaaaacagagtgtttttgtcgaaagataataaatatcctctggcttcttacataatctctgaagttcactgatcacctgtcactcctttagacatcgtttagatgcgtttcatgcattatgaatcatgccactatgagtctttaataggaagatttctaaaagcattgtttagaaatgtcagtgacgttcagtttctaagtttttcatttctcaaacatcactccctctccttgttttatcacattggtcatttccttcttaacccatataccagagaaatccacagataaatgtttgctcagcctaccccaaaaagtcttggaataataatatctaaatgttgttcaagatatttgcataaatgttatctcatttgagcttcataaaaacgtgaagtgtctttacagatgcgtaatttaagaatctggaagctaaaaacatttgtccagagtcacatggctgtttaggtagtagaagcaggactaaaagtcacctctgaccacaaagctggtagatttatcactgtgctgcatctacaagggttgcagatccagattttctcatcaacaccttgttcatgatgttcactcacattttcagctgtgaagtctgttgctgagtcattccttgattttctgcatggttttgcgtaccccagtattagcctacatcctttcctgtattacagctccataaagaattctcataaatgacttgaagtcaccttaacctaactgtctaaaatctctcaaacacatgacaactttcttctcttcctgaacatgagaaaatgtcagtagccgtcctctttgctgcttcccactgttaccttgactctttcagtctactgcagatatttgtcatttgccctttgattttccctattttgattttatttatctatttatttttttactgtgctctccatcagtttgttctgaaattgaaaaatatctatttttctcttcaaagtatttggcttcatttctttccttgagagctttcctcaaattattttctcatctgtaccaatcctctctgacagcttggaatgaaagttgggcttctctccttgaccattcctcatcattttctatgccttctcttagttacatgaatttgctcatcctccatttacttctgccaaatttccaagcttttaagaaattaatttcagctagtactattgcatgatcagaaaaagcgctatctttcatttcatgtgtcggacctctactctctcttgcatataaatcctgtcagccctactggatcacttctttttttatgtaagcatattgcaaactgttagtatgcatttccaaataatcttctttcaagtctacatttttgcacacaattttctaaatattcagcttcactggtcaatttccaattctctctggctctattcccttttctgagatgcaattgaaatgtctctactccaacataaaatagaatggtttactctattttatgaagaatgaaaaaaccacatccttaatttacaaatctgagctgttctcttccctaattgtcatccttgatcaagtcttccagttgagatctcctatctatcatcagacctttgcatgataatgtttaacccaaaatcttaccccattgttgtactctcttcctccttttcaataacaagaaacttaaacttagccgtttcatttgaataattggcaagtagtataagcaagcactctatgttgtaaacataaaggaaatagataaattatttgtaggtaggaagaaacgtggaatacttctttaaaatagaagaacttgagcaaggttaatggaatatttcttttaagagagaagaacttgagcacaggtaggattataataatcaaaatgtagtgtgggatatgactctattccaagtggcaggaaaaaatgtgcacaagtttaggggcatgccatggagttcattttcagaatggctagctcctgttggctgaaagatagcctgcaagtgatatacatcaggaaagataaggtgggggcatgttgtagagcatattgctaaccaaagtagtttagactttattctttagtaaagagtaagccattggaaattttaaaaacaaaaataacatagtagactccaaaatctttactgaaggagtaggtggatgagtcaaagataaatccaaaatgtttcatttgggtgactaggaagagagcaacactctaaacaaagaaggaaaggagggggcttgctggctttggtaaaaagaaaatgggttcagctttggatattactgaacataaggtgttaaaaagccattcaagttgagatagtaatcaaatacatggatatgcaggtctgagaatttagatacacagataaattttggaagtcaaccacacagaggggataagaaatgttgtaggtgtatgtaaaatcaccatgcctgaagtcagaggcaagatcagaaggagtgtccatggagaatacccacgcttacagggtaggaagggaaaggggcagtttaaagagaagaagtggttgtatggaagttagtggaagaacccaaagactgagccaaaggaagagagaatttaaagaaggaggagggtgattaccaatgtcaaatatttccaacatatggaggaggaaaagttctgaaaagcattcaatttgacaattagaaagtcattagaaactgtcaaacaagatgtgtgagtaaaatggaaggttcaaaagctagaaagtaggcgtgagaaagcataggcaacaatgtaaactactttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatctgcccgcctcggcctcccaaagtgctgggattacaggcgtgagccaccgcgcccggcctgtaaactactttttagtaaagtttggtgataaaagaaggtgagaaatgagatagcttatgaatttatcaggattaagaaatgcatgcttttagaattgaagaatcatctgtatgattgcaggcataaggaaaggagcttggtacaaagtaggaaatatatacatttatgtatatatgtatatattttttcattagaaagggaggcagggaggcagggaagggaagggaagggaaggggagggaaatatagggtaaaatatttgtagcatagaaaacaaggacaactactgaagcaagaccctgaaaaagcaacaggtggaattagctaaccatgcacatgctatgggtagctctggcaagaagggaggtgggggcttctttctcagaagcagaaggaaaggataagtccagatacagaaaagagttaaagttgaaaggagagaaaggaccaaacagattttattcctctctgatcaatctaaatttctattacgcacgtttctattcctccaacttctgtgactgggactccaccttcaggaagcctgtagcatttgtttccttgcgtgtgtctctttcattcctgttctgcagatgttttctgtagcaagcctacatcaccatttctttcagtagccattagtttaccccagctgtttcttgctgccccctcagttttactatattcttttattcctttctctacccctacctaacatctatttttattcttctccatcacgtaaacctctcatccacacattttactgcctgaatctcttaactccctttcatatagacccttcctgactagtaaatactatagctagcgatgactacatttttcaggaggttgaactgtgataggaaatgataaccagagaagggatagcatagtggggggaaaaaaccttgaacaagtttacaatataaagaaaaggagtcagtagaaaaaaaaaagggagatgttaaaaacaaaataaaggaaataatttgattccagagcaggtaggaagaaatggaatccagagcacaggtaaaatgataatcttaggcatagagacactcctgctgaggcgggaaggaggaagtaataataggtcaagtgcatacacatttgtaggaggagacatgaactttaagaattccaacctgatgacttctatttcctggagtagtagggaggccaagtactgagaattaaagtggaaatgatggagtactgatgggaggaggctcatgaaaatttcaacatgcttttgtggaaaatggaagagagagtagtctaggaaaaattgagattatcaaacaacgtagaggatccaagcaaaattggaagcaataaatatgtagaggcataaatccacatggatgtgagactgttatcttagtaatacttagcagtctacatgtagggaaatatggcccaaataagatctacatagaggaaaagagttgaattagtgtaggtaaaattgaaataggaatggattccaatgtcccaggggagcatgccatgcttgaaaaactatggtagtttgctatagctggaagcatagtatataagactaaaaagttaatcaaggacccaacaaatgatgtttttatacgctttggcaatggaaatccactgaagggttttgaactggagaatgacttgatcgcatctgtgttttaaaagcattactagaaaatatctatggaggggggaatagaaggaatagacaaatggcaaagaggccatttaagaggttatttaacagtatagatgggaaggcttgaacaagggcacagaagtggacatgaaaggaagaaatggattagagagacctacagagatgattagttgaggatagatttgtgaaaacttggtgactaaatgggattttaggttatttgaatttcatttcttcctcacagattcttcttccttactcccctctgcagatgacccttcctttgacagaagccaaaaagctagtactaattgcatataaaactcataaagtattattgaaagttgaacagtataattgaaagagtatggacttaggagtttcatgttctaagccctactccaccacttaatatcttcatgatttggcacagttaacctcactgagcttcagtttcttcctctgtaaaatgaggatcatatctattttccagagctattgtaaggtttaatgaaatactgcaaacacgtatagaaagtagtttgcttgaatgcttcctggtacgtaatagatgttcaaatggtagttagttctgtttccattatttttattactcttagtatctttgttattatctcagtgtccatggagtgctttttccagattctgctgtcccctccaaggctggtttcatcatgtttcatcctgcccctgccttctcttcactgaagtcataccaagtcacactgtagataggtgactccctaaatattgcccaacaagccacatagtgtcaggaaccctccctgactccagtccaatcattgagccagctggccctaggttcacaccaatggcagaggctgtccctcaaatcaggtcgaatttggctggacaaggaaaccaaccacacaaagatggcctctcagatcattcgtttaactattgccataaatggacacataaacctcctatcattgcgtgtgtcataagtgaatatattatattctcatatgctatgttctcatacattatattctcccaggcatgcctcatgtccaactacctgaaaacatgccaactggaagaagcccctcaaatctcaacacataaggagtgcaaaacacaaaaacaaaatcttagcagccaaggcccctctgactgaatcatggccagctgtctttaaaataacgtatgccaattttatgactgcctacagagattgccctgcaaataaccttgggtaggtggttgtgcctctaattataccccgtaagtgacagaaatcatgctgcatcatgactgtcttcaaattgcagaaaaacagacctaattaaaagagtttcctgatggccgggtgcagtggctcacgcctgtaatcccagcactttgggaagccaaggtgagtggatcacctagggtcaagagttcgacaccagcctgaccaacatggagaaaccccatctctagtaaaaatacaaaattagtcaggcatggtggtgcatgcctgtaatctcagctacttgggaggctgaggcaggagtatcgcttgaacccaggaggtggaggttgcagtgagcctagatcgcaccactgcactccagcctgggcaacaagagtgaaactctgtctcaaaaaatattaataataaaataaaataaatttttaaaaaaagtttcctgttttcctctgaataagtccagtatggtccttttaacagaagcagcatgtttgaggttctctcctcaagaatctaccaagttgttgttcaaaaggattattttcccagaactaaggatcaacttttagtgataacctgacatgggggtacaaaacaaatcgtgcacaaaaggagaccaaaatgtcaggcattttccagaatttccctttggcatcagccctatggtcttaaattgataagagctctagtaagacctttttgggtgctctttaccctacaatcttcctttgcccaagctagaactagggtcagtggcattcttcatgctcacgttttcctaattatactgtagaaccactaccaaattgctagaattgggaccaagtggaatagtgagaagaggggagaaaagtggtctatttaacttcatctcacccttccaaaatccacaaggcttctctcatggacaaagatttcacataatggggacctttacaaagagtgagcagtctgcttggctatgataggagcaaagagttttaagcaacagattaggaattcacatttgggtaaaagcaggtagaacctctgttagcctggagacttcaaggacgttgatgacagcagtacacatgcctcttactatttgaaagggagccgaatgtctacggaatgtagtattaaaagaaactatttagtaattttaatacatctctgtaaacacacgtaattccacaaggctactctcagaggcaaggacgggaagccgtagcaaggaatgtctctattctagtcctaagaagatttgtgtcgctttcccataacctcaagtgtttacttgctcttgtaataaatcaggcctagactatcactgcctaacaattttccagtacgcgtcactttcatttcagctcctgctagtgtaccatgcaaagcacctgtgcatagtaattaattttaagcatttatgcatgctagtaaacaattctagcacaactttgtggttgtgtttcactattaaattagccctttttgttttgctgaagtccacatgtgtgtttatgtatgcatgtgtttacatgtatctgtgtaaacaataagtaacaagcaaaaacaagccagtgtcctacaggaacgagagcagtgagttttttactatgtgtacctgtttaccctcactccaggctaaattgtgtgcccctgtgttttaaagttaaataactataactacctatgaaatcacatagcacttccactttaggattatcaaacgtctgctagcattttcttaatatattcgatgcagtagctggatcccaggaattcacctatgaacactgaaagattacttctgatggcagacatgaaattagttgctccaatttttgaactagatggaaccaactggaatagactacagggtgagaatatacatgtgagtttgagtgaatatgtcatttaaacctaatttttgtctcattttcaggcagttatatagaatttcgcttaagaaatactggaacataactgggaccttgaagaaactaaagggtttgacagcataattgaaatggcaaagtctgctttcatctttagtttctctagtgaaagaagtgactctatgtctccctgaaagcccaaattggagaacaactaggtcccccagaactggtccagaaaattagggataaagaagtgccatttttcagtcctacatcaccattattcaatttctagtggttagacaaagtgtacccagcatggaattttgaaaggcaggcagatgagcctcctccacagctttttgttggtctacctctcgtcttctaaagaatagtgtgctgggggaagtagctaaaaatgaaaaacattgaacaaagggtcacaagttacaattgtattaaagactttgagtcagataaggccactttgagtcagataaggccaagtactagctggaaacaaagaaagtaagagactgacaacatgagcagtttaccatgaccttctacttagactctgggataaggtctctgtgacgggtactcactgaaaattgagagacaaagaagtaaacagttataatttggggtggaaaatgctgtgaaggaggtaaatgcaggattctacaggattacattgacacctaccaccaacttaaagaataacggtaagcagggagggcttcttttaagatacgacatctgaaatgagtttctaaagacaaataggatttttcctgatgaagcagtcattgcaggcattacacctggagagaaaatattctgtccaaaggcatgaaggtatgaaagaggagaagcatgtgctaactgcaagtagctctgtttggctggactgtaaggtctgaagtggtgaggaagagatggaaagatagggaggatagtgcataggaaggtaacaggctgcagcagtgagccagagccggatcatgaaaggccttctgtgacactatactgggagctgcgtataggccatgactcttaatagctaagcttcatgggaacagaaactatgtatatttcatttgtgggttcatccccaatttctctaacattgtacatagcacaaaatagaggtcccaatagcagcatgaatgaattccatgccaaagcatttaaacatcatcctgaaggctaagaagatcattcaatggtttcaagcatctagggacatcgctagatttcaattttatataggctgtggttgaagggtggagaataaatgggaggggttaacactggatgtgagaagcaggtctataaggctattgtagtaatccaggcgagagaagatggtgggcagggatgggggatttggaaaattgggtaaatttaggaggcatttagcaaattgcattaacaggacagggtaactgatgagaaagaagatggaaagaagaatgtgtcaaagatgatactaccagtttgatgatttgaacaacaaggtggtactatttactgaaattgggaatattggtaaatgagtgagtttgtgaggcagagaagggtatcattggtggggctatggcatcggaaaggggtgtgggaaaattggaggcaaggagagtaaggaaaatatcagtttcattttggaaacattgagtttaaggcatctgaaggatattcagattactgtgtattcagtacccagttgactatatatctgaggctcagaagaaaaatctggaaatatagatacgggagttgcatatagatagcagttgaaagtatatgtcccttttggttggctccttttttgttgctgttgtttgttttgagaagaagtctcactctgtcacccaggctggagtgcagtggtgcgatcttggttcactgcatcctccgcctcccaggttcaagtgattctcctgcctcagccctccaagtagctgggattacaggcgcgcaccactacgctcggttaatttttgtatttttagtagagacgaagtttcgccattttagccaggttggtctcgaactcctattctcctcccaaagtgctcagattacaggggtgagccactgcgcctggcctggttggctcccttaatgactccttttataccccggcccagtgagctctgcctaaaagctaattcaccacaacttgaattcctaatgagtatttaatcttcttcctaatgtcttgtaacccagcccaggccccagcggtaccatctaatgaatccctcaggagactaagattccacatcctaaagttagtgccgcttgtagccacagctctcagcttctaacagcacaagggtgccctctagtgttcagcatgatgcatacaggggcacagagaactctgaattgtgaacctcgcctttcaaccaggatcactgccctgccaccttcacttctggggaaattcactagccacatacaacctcaaatttggagggactctaagtacttcagattctagcagggcatgaagagagtcaggcaagccgtactctcttaaggcaatgtattttttcagttgcccatcacagttagggagtagcctgtagtgtcatctcttgagtagaaccgtctaggttctcagtaagcctcagggggaaaactacaagatagattggtcagagttatactattatttcagaaataataagccacagagtgtagatacatatgtgtctaccaaactagagaaacacaaggacccatgccacaggcctcctggttgcactagtctcttaatatatcctacagcagggttaaccactttgtccacaggtgccactcccatcactagaaacttttgtatactaaccagggagccagggtgaaagtggaaggatcatcttttacccttacctacaaagggctgtgggaagggcagtacatcataaggaattctgggtggtacactcacctttacactagtgaagagatccccttgttcatatagcagattaggaagaatagagatcctcctataggatcggtgtgctcatgagataacatgcaataggaatcggcgtgctcatgagatgagataacatgcaacaaaaccccagtattactactgtgttactgcttctactcaaccctctacagagtggagatccaagtgcctacctcactatagcctaagaaaacctatgccctaaaaaagaacaaaatcatgtcctttgcagcaacatggatgcggctggaggccatcagcctaagtgaattaatgtgggaacagaaaaccaaataccgcatgttctcacttataagtgggagctatgcattggctatacatgcacacaaagatgggaacaatagatactggggatcccaaagtggggggaagggagggggcaggggttgaaaaactacctattgggtgctatgttcactacttgggtgaagagatcattagaagcccaaacctcagcatcacgcaatatacccatgtaacaaacctgcacatgtaccccctgaatctaaaataaaatgtttttagaaaagaaaaaaaaagaaaacctatgcttttcatcttattttgcaactctgccttaagttctaatatggccctccaccatctgtcatttccttacctaggattccaaacaaatatgccaattaccagaagacattttcagaactgaaggcagaactgaaagtatgattaacctgagtatgatgtcaagcacttgaattgtttcgctaaggctaaggtcaagtcctttcaacaatatgtagataataactatggcaaacttacatcatgtcccagtactagacatatttatttatgaaatggctgcctattccaatcattacctcagcatcacaacaataaaactttgcccatacctattgactcagggcctcccagatcatcatggcaaaccataagtttgtttttaatcatttttggagtttgtttgcatataataacatttacccattttgaatggactttataataagcactgacaaatttatatacctcctggaaataacaactgccatactcaaaatacaaaacactgtcatcacctcctcccaaaattcacttctgcccatcccagtcacccagagacccacttcaagcctaaggcaagcagtattttttattttgtcatcaagaatagatttgccattcctgaagtttcatataaacagaagtatacatgatatcctcttttgtgtctatcttaatttaacaaaatgttcttgaatttcatgttcaagttaaagttatatcccactgtggttttaatttgaatttcccaaatgactgatgacgttgagcatcttctcatgctctcagtgcacatttctatttttttttttttttttgaaattttgaaccattgtttttatgaaatggatttgtctacagcatgaatgagactgatgtgtggaagatggtagctcacatgtgccacaagcaatatttttttgctgtttgtcttattcagtaccctatatattttcagaaacagatgaattaaatcccatatgacctcatcatgaaatcatggtatccttttttttttttttgagacagagttactctcttgtcacccaggctggagtgcaatggcgcgatcttggctcactgcaacctccacctcctgggttcaagcaattctcctgcctcagccccccaagtagctgggattacaggtgcccgccaccatacccggctagtttttgtatttttagtagagacggggtttcaccatgttggccaggctggtcacaaactcctgacttcaggtgatccacccacctcggcctcccaaagtgctgggattacaggcatgaaccactgtgcccggccaatgatatcctatattctattccttataatgagattacagagtttcctggccacttgatatagcaccacttttggaataaccctgcaaaaggcctacttaaaagttgaaagatagaattattggaccatgttctatatattccatatgatgaaggcacataattgcctattatgcatcaatcacattaaacttaggaacactccaggtaaatgaagtttgtcctgagatttctggcatttatcaggttctacccacagttcattacttatgttatttttctagttagcctgataactgatttcaagaaagggacagaatttgtttcattggcaattttacttactgggctgtaggtttgtgaaatagtgatcctctcagcccttagaacggccatgaagacctatggcattcagagcatggggtaagttgccttcaactttgaataatcttgcccatttccttagtataccatgtacacaccattttctataagtgttaaaacatgaaattttggggagcactaatttagtcctctgtcatagatgtagccatccagcacatgaaggtactattttctaccctaattctctctcctacacctaatcctccctggccctaaaaccagcctactccaacctagcaaattctttatttatttagtttttttttactattatactttttaagttctgggatatatgtgcagaatgtgcaggtttgttacatagctatacatgtgccatggtggtttgcttcacccatcaacccgtcatctacattagatatttctcctaatgctatccctccccttgcccccaccccctgacaggccccagtgtgtgacgttcccctccctgtgcccatatgttctcattgttcaactcccacttatgagtgacaacatgcagtgtttggttttctgttcctgtgttagtttgctgagaatgatggtttccggcttcatccatgtccctgcaaaggacatggacacgttcttttttatggctacatagtattccatgatgtatatgtgccacattttctttatccagtaaaatattgatgagcatttgagttggttccaagtctttgctattgtgaatagtgctgcaataaatagacgtgtacatgtgtctttatagtagaatgatttataatcctctgggtatatatgcagtaatgggattgctgggtcaaatggtacttctagttctagattttttttttttgagatggagtcttgttctgtcaccaggctggagtgcagtggcggatcactgctcactgcaacctccgccacccaggttcaagtgattctcctgcctcagcctcccaagtagctgggactacaggcatgcgccaccatgcccagctaatttttgtatttttagtagagatgaggtttcaccatgttagccaggatggtctcttgaccttgtaatccacccacctcagcctcccaaagtgctgggattacaggcatgagccaccatgccttgcctgtttcctgactttttaacgatggccattctaactggcataagatggtatctcattgtgattttgatttgcatttctctaatgaccagtgatgatgagctttttttcatatgtttgttggccgcataaatgtcttcttttgaaaagtgcctgttcatgtcctttgcccactttttgatggggctgtttggtttttttcttgtaaatttgtttaagttccttgtagattctggatattagccctttgtcagatggatagattgcaaaaattttctcccattctgtaggctgcctgttcactctgatgatagtttcttttactgtgcagaagccctttagtttaattaaatgccatttgtcaattttggcttttgttgccattgcttttggtgttttagtcatgaagtctctgtccatgcctatgtcctgaatggtaatgcctaggttttcttctagggtttttgtggttttaggtcttatgcttaaatcttcaatccatcttgagttaatttttgtataaggtgtaaggaagggatccagtttcagttttctgcatatgactatcctgttttcccaataccatttattaaatagggaatcctttccccattgcttgtttttgtcagttttgtcaaagatcagttgccaacctggcaaattcttatactgtgatgaaaaatgtctccaactacatagtgatgaccatcatatcctcagaaaatccctgatttggggaacatccacctaaacacctatttgtttaagaagttagcaagacacaaagtcaaccatattttatgggaatgagaatactcaccaccaaggccttctttgggacttagaggtgatactacactcagaactccatagctaagagcagctaaggcaaacccagaagctcagtttgtaccaggtattcattctagaagtattactaagcgcttagagtgtatcaggcactggtgcaatgcttgatggaccacattcacagaattttttggtcttactaggctgcccaaatcaccaggtcttgagggcagattatctcctttagcaagtcctccctggcagattatccaaactatgaactttaaggccatctatttccaactataattaatcagaataatctggcagaggaagtaggcaaacacacaggcatactgatgccagactgaaagtcaaatatacccagaaacgataatgtaaagtacagaataacaggctgactcccatttagggaggcctgtccttaaatactgtgcctatgcaaagacatttatgtctggtgattattcaagatattgattaaactctacagagacttttgaaggattcatgtttattactgcatcctccaatagaatagcatctagaaaacctgtagttagaacaagaaatacctttagcaattcagagaaataatacaccactcactgtccctatatgtgtctctaggattccagaacattaaaatgtatctttaacttgctccctttccactgccataacttcaacctggtgattatgtaattattcactaaaatggcacattttatccatatgctggttctttatccattgacattaacataatactacaactgaaattagtgagctattttgttttcagaaactctgatgttttcaactatgacaccaagattgaagaataatattgaaggccttttgtaattgcatctactatacatggctaaatgcagcacaaccagttttttgaggaatacttcttctgttctgcttacagacaactcaatagttcaacctacttcgtagagtttggctgcaacataaaacattcacatgaaacatcctcttcaaagaaaccattattatactagaaaagaaaaagaatctcaggaaaatagaaatggacaggaacttccttaacttgccaaacaatatctttgaaacatacaggtcatattattcttaatattgaaagactgaatgcttgttcttaaaagcaacctcaagagaaggataactattcttgccacacctattcagcgtagtattgaaagttttagatagtgaaataaagcacggctagaaaattaaatttatgcataggagaaagaaagaaacaaaacagtccttgtttgcagataatatgattgtctacatagaaaataccaaggaaaccataaaaatctcctagttagtaagttgcaggatacaagatcaacctacagaaatcaattgtatttttatatgctagataagaacaggtggatacgaaaaataaaaaacataatgccatttacaattgctcagaaagtggaagacttaggggtaaatctaacaaaacttgtaaagaaattacaagctgaaaactacacaatgctgatgaaagaaattttaaaaatctaagtggataaatggaaagacatagtatgttcatggacttgaagactcaaagcagatgtcaactctacccaaattgacacacatatttaatgtaattcctgtcaaaatccaagcaaaattttgtatatataggttatgcatatatatatgtatatacaatagataagtaaatatgtgatagagatagacaatatacctacaaaaatgcctggattttggtacgaattattgcaaaatttgtatgaaaagtcaaaagactcaaatagctaaaaacagttttttaaaagtacaaaatgggaagactcagtgtacccaatttcgagtttattatataactacagtaatcaagactgcatgatattgatagagtgatagacacatagatcaatggtgcagcacacaaaacccagaaatagacacacacaaatatgaccattgattttcggcaaaggtgcaaaagcagttcaatggaggaaagatagcattttcaacaaatggtattagagcaattgaaaatccatagggtaaaaagtgaacctcaaccaaagactcataccctatacaaaaattaactaaaaatgtattatggacttatgtaaaatgtaaaattgtagaacttttaggaaaaaagcacaagaaaagctttggcatatagggttgggcaaagagttcatacacttgatacgaaaagcacaatctataaaagaaattaaatgatagtttggacttcatcaatattaaaaactttggctccatgaagaaggataaaaaaactttggctccatgttaaaaggataaaatacagtctatagagtaaaagaaaatatttgcaaatcacaaatctgacaaaatacctgatatctatagtatatatagaaaaaataagcaatccaattagaaaataatgaaaagacatagacctttcacagacaaggatatacaatggtaaataagcacataaacagatgtaaaacatcattagtagttaaggaaatgcaaattaaaagcacaatgaagtatcattacacaccaataagaatagataaaataaaaataattacaactccaaaagctggcaaggatatagaggaattggacctctcatgcatacttgatggggatataaaacagtagagccactctgaaatagaatttcaaagtttcttaaaaatgaaacacaacccagcaattgcccttctgggcatttatcccagagaatgaagccttctgttatgtagacacacacatgcacagctacttgtacacaggtgtttgtagttaatttgttcataattttttaaaaaactgaaaacaacccaaatgtccttcaataggtgaatgcaatgagtcaatgcaacgggttatgtgactgtggtgtatccataacatgggatatttctcagcaatggaaaggaacaaactgatacacacaacctggattagcctgtagataattatgccgagtgaaataaccattccctaaaagtcacatactgtatcactccattcatacaacaatcttgaagtgacaaattatagaaacggaaaacagattagtggttgccagaagttaaggagctgatgagagcaggacggaaactagcatgactacaaaaagacaacatgagggatcctcatggctatggaaatgtttcaaatctttactatatcaatgccaatatcctgtttctgatattatactacagttttgcaggttgttaccattggagaaaattaggtaaaggatgaatgagatctgtatgtattttattttgccactgcatgtgaatccaaaattatttcaacataaatgacttaattaaaaataaaagtatccattaaatatccataaaattgatacacctttagctagactgatcaaaaaagagataattcacaaatcaccaatgtcaggagtaaaagagggaatatctaccacaaaggccacagacatcaaaaggataataagaaatattattgtctcagtaagattggttgagctactataacaaattaccatagactggatggcttacgcaatgaacatttatttctcataattctgaaggctgtaaggtccaagatcaaggtgccagcagatccagtgtctgctgagggccagtttcctggtttgcaaatggccactttctgcatatacccttatgtcttgtcttagaagaacactaatcttattcagaaggactccacccttataatttaattacttcctaaaagccccacctcctaatatcaacacattgggggttaggttttcaatatattgatttgggcaggacacaaacatttagtctataatattctattcctggcttcaaaaagtcatgcctttctgacatgcaaaatatattcatttcatcccaacaaccccaaaagtcttaactcattccagtgtcaactctaaaatctggagtccagagtcttgcctaaatatcatctaaatcagttacgggtgaaacttgaggtaagattcatcctgaggcagaattcttctccaggtgtaaaccagtgacaccaaacaagttatgtgcatcccaaatacaatggtagggcaggcatatgatagacattgacaaaatagaaatttggtgggggcgaggaaaataagaaggaaggagtgatgggctccaggtaagtcaaaaatctagcaaagaaaactctatgaagtcttaaggcttgagaataatcctctttggtttgatcctctgtcttctggacccactgcagcaatagccctgcctccacagctctgctgagttggagttaagtgcccatggctctgcctagcagatgttatgagcccacagtgagattatacgaacattggttcagccctttgggactgaggtgaagaagacctgcctcccaggcctgtgcattctgggcctgtagtgggagtcatagccctgatgatctctgaatcaccttttggggtttctttccttgtctgaagaataatgcatgtccacagctggaagagatgtgtgatctgggtctgtaggcgctaagaagtctgacagtcttcttttacttggtcctattttctgttttcttcagtcaaagctggcagtgtttctgctaacataatgccatctctattcctggcttctgctgagattgctgaataggtccatgtttcacacctgcactaatctccttaataaatgattggtctaccacacctgtagtgttttcttctgaactcactttctcattttttgttatgcacaggctgacaattttccaaatctttaagttctgataactttttgataagtaattgtgtcttcaattcatttctgtccccttgcattttactataagcaatcaggaggaaccaagccactccttagacgctttgtttagaaatttccttggctaaatatccaattttattgttcacaaactctaccttccacaaaacgctagaacacaaacataattcagccaagttctttgccactttataacaaaaaaaatcacctttcctcctgtttccaataatgtgtccctcatttccatctcagacctcatcagaatggcctttgccatccacatttctatcaatattctgttcatgattatgtatacattctctaagaagacaaaagttttctctacagatctccatttttctttctgagctatcactggaatcatctttaaaaatctcttcacagcaattctggcttcttctagcatgtacctctaaaccattctatcctcaacccattacccagttgcaaagccactccacatttttaggtatttgttacagcagcagaaccccacctcttagtaccagtttctgtctcagtcagttcagacttctataccaaattaccatagactggatggcttaagcaacaaacatttatttctgacagttctggaacctggaatgtccaagatccaggtgccagcagagctggtgcctgggcccacttcctggtttgcagacaactgttttctttttagatcctcacatggctaagagcagaaagtaagaacaagctctcatgtctcctcttataagggcactaatcccattcagaaggactccaccttaatgacctaattagtttcctaagacaccaccatcagataaatagcaatcccccatgaaatgtttcaaaaaaattagaagtgcatgctttgaaataattttatgagtccaacataacactgcaactaaaatcagaaaaaaaggtatttaaaaatgaataaaactgtagatcattttgcacttatccccatgtatacaatactttttaaatactggcatattatatacaagaagaaagataaattaccaaatgaagtatattcaagaaatgaaatatatgctggtaagcaggctctctggctttcagactttgtctttatttactatctaatcatgttcagtttctcagtatctttctccaaaacatcaataaccccaataataataatccaatttcttagccttcatgtttattatgtcccccgtgcctctcaaacatcaaagacattgtacctactagtatatgccttgcattaatgctccatcccagttcaccaccagtacaagtttcaacaaatgcatgacagaggatattagtgttttacctaccatcagtgaagggtccttctttgtcagaaggtcagcaagaattaagttggaaatcccattacagtgctgcttcccaagtctaacccccacaagatgggtgcctcaaaaaacagaatctgaaaaaagaatttgcatataagaaatgtattggtggccagacgcagtgactcacacctgtaatcccagcactttgggaggccgaggtgggtggatcacttgaggtcaggagttcgagacctacctggccaacatggtgaaaccactttcctactaaaaacacaaaaactagccaggcatggtggcgggtgcctgtaatgccagctacccaggaggctgaggtgggaaaattgcttgaaccccagaggcagaggttgcagtgagctgagatcctgccactgcactccaggctgggcaacagagagagattccatcaaggagaagaagaaggagaaggagaaggagaaggagaagcctatcaatcctatggagagctctagaactgggatgaatctggaaaggtgacccacattgagacaagggggctgggcctttatacttttatactccaacttgaaccagtgaatggacacaggcttcccctgaaagggaaatcataatatttgaagaagtggctccaattgtctcaaggaaatttttgaggagagattcagagattcatctatgagctgtcagcatgcaacactattggcagctggggtgataggtgtcttagtcctgagagggaagagagggcatatgggcagtacacacagcatccactactactactacacacacacacacacacacacacacacacacacacgcacacacacacatatacactgtatatacatagtatacatataatcattgtatatgtatatatgtatacaatgtctgtatgtatcactgtgtatactgtatatatatgtacacactgtatgtataaatataaacatatactttgtgtgtatatgtatatattcaacaacatgcttattagtgtaacaacctgcttcatcccttcttcaatacacttttgccccactttcattcatgtccatatttctagcctcatatcctgttctaattccttgtttatgagctagttctgactgcttccacatcagatctaagatatctctgattaattgggatccatggagagggtgtcatcatcattctcggaagccttagtaacatagataggaataactcaagtttacataaaccccccaagatagatgtctaccaaagtcctgcctttacaagtgctctatatgggtttggagtgaatctaacagaggccatatccaagagacagtatgtttaatttgtagagttttgagacttgtctggatccaatgagagatttactcagggcagcctgaaggagaaaagtgaagaagagtttaaactatggtcaatgagagaagctggaaatcagaaaagccagaaaaagcagcacccataattgaaactgaggagtaaggcaaggtcacaaacatgaaaacaaaggaaaagtttcttgcagtaacaccagttggaacttctcatcattaactgtatttttcctagaaatttctacagaaaataaaataagaatgctgtggtcaaaagggcagagtattcaaacagaaagcagaagaaaactgctttctctgtccagagaaactaagctccgtcacttactaattatatcacatatggcaaatcacttaacctatctgaggccctcatattttcttcatatctaaagtgaggatatgaatataggtacccatttcctgaaaaatttttttgagactcaatgaattaccaaatatgaagattttggcttcatagtaatgtctgctttcagagagatctataagatgcttctcgagcaggggacctgctggaggactcccctaaatgtcccaaggaagcagaaaaccctgaaggggagaagaaggaggcagccaccttggaaggtgagaagacacttcttgtggaggtggaaaagaatagcaccctctctgagcccggctctggccgggggcctccccaagaggaagaagaggaggaggaagaggaagaggctgccaatgaagatgctgagaccccaggcatcagagatcatgagagtctgtagccaccaatgtttcaagaggagcccccaccctgttcctgctgctgtctgagtgctactggggaaactggccatggcccgaaaactgggaacccctttcccaccccaacctgctctcctcttccactcactattcccactccaagcccagaccatggagattgacctggatgagacaggtcacctggccctcccctctaggtccccatacccctattatcagagtcagagccatgtcttctgctccctgggaagagatgaggctattatgttccttccacttggagctattttccaggcttctgctggggcctgggccaactgtttccacctcctgacatcctttccccactctcttagtcattctgggactctgggttgggatcaggggtgggaatagaaaagatggagcataaacagcagtgtgggcttgtggggcctgggaggggcaatcctcaaatggaggataggggtagcacaggagggtggcatcttcctgagctcctgtcccctgctacacctattatcccagctgcctagattcaagtaaagtgggacagcttgtaggggaggggctcctttccataaatccttgatgattgacaacacccattttttcttttgccaatcccaagagttccgggagttgtagtttatcatcaaaagattttggggcttccaagttgtttgggccaaggacctgagacctgaaaggttgactttacccatttgggtgggagtgttgagcatctgcccccatttagatctctgaagccagaaatgggatgcttgggaaggcccctagctgcccttttccctctctgcacagtgctgaaggccagcttatagtcatatatatcactcagatgtaaaggaaaagatacattttttaggaaatgtttttaataaaagaaaactaccaaaaaaaaatgtaaagacccctaaccctttgtgtgctccgcattctgctccttccttccccatcgttgcccacatttctgaggtgcactgggaggctcccctactatttagggctttatgactttctttttgtagctggggctttggtgttccttccagtgtcatttctcatccacatacgctgacctgttccccttagtgttgtcaccagatccgatttgtaatcaactgagaggacagagggaaataagtgccctctcccaccctcttcctagtggtctctctatgtctctcttcagtatctggtctcttttaccctggcacctctcccttgggctctgatgaaaaattgctgactgtaactttggaagtttagctctgagaactgtagatgatttcagttctaggaaaataaaacccattcattaccaaaaaaaaaaaaagaagaagaagaagatgcttctcagcacatcgaatcaccctgggccatccacaaaaggcacaccttttcagtttgcattcataaaaattaattcctgaatgacttctatgccttttttttttttttactttatttcaggttcagggatacatgtgcaggtttgttaatacaggcaaacttgtgttacagaggtttggtgtacagaccatttcatcacgcatgtactaagtagagtactcgatagttatttttcctgatagttatatctcccttctgccaccctcctccctcaagtaggccccagtgtctgttgttcccttctttgtgtccgttggttctcattatttagctcccacttaataagtgagaacatgcagtatttgggtttctcttcctgagttcgtttgctaagaataatggcctccagctccatccatgttcctgcaaagaacatgatctcattctcttttatggctgcatagtattccatggtgtatatgtaccacattttctttatcaagtctatcattgatgggcatttaggttaattccatgtctttgctattgtgaatagtgctgccgtgaacattcgcatgcatgtgtctttatggtagaatgatttatattcctttgggtatatacccagtaatgggattgctgggtctaatggtagttctgtttctagttctttgaggaatcatcacactgctttccacaatgattgaactaatttaccttcccaccaatcatgtataagcattgctttttctctgcaaccatgctagcatctgttatttttctactttttattaatagccattctgactggtgtgagatggtatctcattgtgattttgatttgcatttccctaacgattcatgatattgagcattttttcatatgcttgctggccacatgtatgtctttttttgaaaagtatctgttcatgtcctttgaccactttttaatggggatgggtttttttttgtaaatttaagttccttatagattttggattttaaacctttgtcagatgcatagtttgcaaatattttcttccattctgtaggttgtttgtttgctcagttcatagtttattttgctatgtagaaactctttcgtttcattagattcaatttaccaatatttgcttttgtcacaattgcttttggtgtctctgtcatgaaatctttgcctggtcctattccagaattgcattgcctaggttgtcttccagggttttatagttttgggttttatatttaagtctttattccatcttgagtttttttgggttttgtttgtttctttttgtttttgttttttgagatggagtctcacccttgtcgcccatgctggagtgcaatagtgcaatctcagctcactgcaacctccacctcttgggttcaagcaattctccggcctcagcctcccgagtagctgggactacaggtgcctgccaccatgcctggctattttttttttaatttttagtagctacaaggtgtcaccttgttggccaggctggtctcgaacttctgacctcaggtgatccacccaccttggcctcccaaagtggtgggattacagacatgagccaccacagccagcccgtcgtgagtcgtcttgagttgttttttgtatgtggtataaagaaagggtccagtttcaatcttctgcatatgactaaccagttatcccagccccagtactttccccattgcttgcttttgccagctttgtcgaagattagatggttgtaggtgtgtgaccttatttctgggatttctattctgttccattggtctctgtgcctgtttttgtaccagtaccatattgttttggttactgtagccctgtagcatagtttgcagtcagctaaggtgatgcctctagctttgttctctttgcttgacttgtgtatctcttgtagtagcttggtctcatggttctattaattaactcttgtggtgctctcatgaggtctttttctgctcaactgcctcctcccaggctcaggctgaatttccttctttggtgaaagactctaggaatctcagcctgttttctcatgttctctctctctctctttctctctctctctctctctctctctctctctgcttctatcttctattttcatgtttagagttctactgccttccctccaagtgtggctttgatgcttcagttttcccctttcttgaatacaggatcttactactgtaaatgttttactgaagatcagtgcagaaaaataaaagacatgaaacataatataactcgaggagtatcagtggattacaagccacagaattctaataatcatttctctatcattccaaactcccttgtgggttgggtgttttctcccagtaagtggagtttcagaggtgcttccatcctgattgcctgattgccacttgagggtgcatcctatgatgcttgaaaccccatcttctcatcttgaatatggaacacaagcgtgttcccgaaacaagatatcctaaatatccctttctgcagtaggcagcaggtatctctgacctcagaaatatcacacaagtaacccattgctgactaagcctgtaagtattttattgctcacactgctactcatagcatgtggcttctctgctgctcagtttttccattttataataaaatttactcttctttctagctttcaatcttcctgctttatttttttattctgattggtgtcctacttcaattcagaagaggcttggccatttcaaagaccaaggcaagccctttggccttttccattcctctaggtattgtagcaccaaagaacaattggtcacaaacacaattctaatacattctctgggcacagccatgtacaagacttgagctggcctcactgcagccatctccagggaaaccagaaaaaaaatgtgcattttgagaagctggaggtcaagtccctctggcacatattttttccacaacgaatgacacaggtggaagtgacctaagcaaaagtcatataaactaagtcttagatggacctgcttctccccagcctacgatcaaaggtcaccctgagctttttcaacttcccacactactaccaactgacagagagctatcacaaactttcttagcctcactgcccagctatctaactttttaaattgaaataacaggtctgcagaattgatggacttttttctccatcacccaagcataaaattctctgacccaagggtccattcatactttcaaaaccaaaacaatattataccaaaagaattcacagaattgtgcactgttatgttgtacttgccccatcatatgtaaatatccttgggattgagctacaaagtgctataaaaagatacactatttgcagacactacatatgaaaatgcaatcagagattctttcttatattttatttttaatttttgtgggcacatagtaggtgcatatatttatggggcatgtgagacattttgatacaggcttgcaatgcataataatcacatcatggcaagcggggtatccattctgtcaagcatttatcctttctgttagaaacaatccaattacactcttttagttatttttaaatgtacaattaagttattggctatttagtcatcctgttgtgctattaaatagtagatcttattcattctttctatttttttacccattaaccattcccacctgcccccaaccccagccccctattgcccttcccagcctctgataaccatccttctactctctatgaacaagagacgaattttgatttttagattccacaagtaagtgagaacaggcgatgtttgtctttctatgcctggcttatttcacttaacataatgatctccaattcgatccatgttgttgcaaatgacaggatctcattgttttttatggctgaatagtactctattgtgtatatgtaccacattttcttttctttttaacagatagtttgaacttttatttatgtttaattttaatttttacaagatgtcgatagtagctggcttattaatgtacattattctttgatatttcaggaaggcacagtgttcaactgtgaactacagagtcctgaaagtttaaaatcagtttgtttctcaaccatgtgatatccaggattttttacaattactttgagatttttcctcatcagtaatgcaaagaaaattgcaatatgattatacaatttttttttattttttgagacaggttatcactctgtaacccaggcttgagtgcaggggtgtgattgtagctcactgcagcctcaaactcctgggctcagacgatcctcccccagcttcccaagtagctgagattacaggcacgtgccaccatgcctggctaatttattttttgtagaaagaggggtctcactttgttgcccaggctggtctccaactcccgggctcaggcaatcccctgcctgggccccccaaagtgctggaattacaggcatgagccactgtgcccagcctgatatacaatttctttctgagacagagtctcgctccgtcgcccaggctggagtgcagtggcacaatcctggctcactgcaacctgtaccacattttctttatccagttatctgttgatggaaatttaggttgtttccaaatcttacataatgtgaacagagctgcaacaaacatagaaagtcagatatctctttgatatagtgatttccgttcctttgggtacatactcagtagtgggattgctggatcatatagtagctctatttttagttatttgagaaacctccaaacgcatctccatagtagttgtactaacttacattcccatcaacagtgtttgagggttcccttttctccacatcctcaccagcatttgttattccctgtcttttggacttaagtcattttaactggagtgagatgatatatccttgtagttttgatttgcatttctctgatgatcagttatgttgagcaccttttcatatacctgtttattatatgccttcttttgaggaatgtctattcaaatcttttgcccattttttgaaaggattattatatttttttcctgtagagttgtttgagctccttatgtgttactggttgttaatcccttgtcagatgggtagtttacaaatattttctcccatgttgtgggttgtctcttcgtgttattgattgtttccattgctgtgcagaagccttgtagcttgatgtgatctcatttgtccatttttgttttggttgcctgtgtttgtgagatattgctcaagaaattgttgccgagaccaatgtcctgggaagtttggccagtgttttcttgtagtagtttcagtttgaggtcttagaattaagtctttaattcattttgatttgatttttatatgtggtgagagacaggggtctagttttcttcttttgcataaagatatccagttttcccagcactattgtatcaaagagactatctcttcctcagtgcatgtttttggtggctttgccaaaaatgagttcatggtggctgcatggatttgtttccaggttctctactttgttccattggtctatgtgtctgtttttataccaataccatgctgttttgggtactagagctctgtagtataatttgaagtcaggtaatgtgattcctccaattttagttttatttgctcaggatagtttaggtggtcctgggttatttgtggttccacataattttaggatagtttattctatttttgtgaagaatgtctttggtgttttgatagggattgcattgaatctatagattgctttgggtagtatagatattttaacaacattgattcttcctatccatgatcatggaatatcttttcattttttggtgtcctcttcaatttctttcatcagtgtttcataattttcattatagagatcttttacttatttggttaattcctaggtatttgattttatgtgtggctatagtaaatcagattacttttttatttctttctcagattgtccactgttggcatatacaaacgctactgatttttgtatgttgattttgtatcctacaactttactgaatttatttatcagttctaattttttttgtggagtcttcaggtttttccaaatataagactatatcatctgcaaacaaggataatttaacttctttcattccaatttggataccgtttatttctttctcttgtctggttgctctagctaggaattccagtactatgttgaataacagtggtgaaagtgggcatccttgtcatgttccagatcttacagaaaaggctttcagtttttccccattccatgtgttactaaccgtgactctgtggtatatgacttttattatgcacagaaattctgagtggtttgcacctagtgcaatatgttcaagtatgtagaaatttattatccacataccaggagggtaaagaaagtctattgagaaccaaagacctatgatactctcttatgatccccaagggttcctgcattatcgtttcactggactctctattttaattcagtctagggctatgttccactttttcatggcacatacactggtaaagactacgctttgcctttgtgtgttattttattagccaggatccttgaggaaaacagatgccacacatagactgggtaatttgataacagtttaataaaaagacttttaaggtaattaataaaagtgtgggaagaatttctaattaagtattctgttacggacaacagggaagagccattaccatgcctagtttggaagggttgggggggtggtcactggaatccagagaggatagcaaaaatgtaggtaacataacaagagccatgacagtcaccaggcaaaataaagtcaacaatgatgaccctttagggaagaatccagaagaataaatactctgactttaatttttccccacctcccaatattgtccccatggcttctgttggccaaacccaaccagggacagaaaaccaatgaggaaacattggacttaaactgtattttagacctaatagattgctaagatttcaaagccccctccaaaactcatgttgaaatttaattgccattgtaacagtatcgagagtaggggcctttaagatgtgattaggccatgaaaactccacccacatgtgtgggtttaatgcctttaaaaagagggcttttgagagtgagttcttactcccttgttcgtctgctttccaccatgtgatgatgaagcaataaggccctcaccagatctgagcccctcaaccttgaatttctcagcctccagaactataagaagtaaatatctgtttttaaatagattacccagtatcagatattttgttatagcagcagaaaactgactaagacagaaaattggtacagacaattttatgtcaacaaagttaagttgttatcagctaaaaataccctgttataaggttttttatgtaaggcttgtggtaaccacaaagcagtgtattttatgtaagccttgaggtaacccaaaagcaaaatcctatagtacatacccaaaagataaaaagtaatgaatcacagcatactactagagaaaattatttaattgtgaaggaatacatcaagatatgaagaaagaaataaagaatctgcaaaacaacaagaaaaaaattgacaagagagcggctggcaatatggccaaataggaagagctccggtctgcagctcccagcaagatcaacacagtaggcgggtgatttctgcatttccaacagaggtactaggctcatctcattgggactggttagacagtgggtgcagcctacgtagggtgagcagaagcagggtggggcattgcctcacccaggaagcacaagaggtcggggaactctctcccctagcaaagggaagcaacgagggactgtgccttggggaacagtgcattcctgcctagatactacactttcccatggtcttcaaacccacagaccaggagattccctcaagtccctacaccaccagggccctgggtttcaagcacaaaactgggtggctctttgggcagactctgagctagctgcaagagtctttttttttttttttttcgtacaccagtggctcctggaatgccagcaggacagaaccgttcactcccctggaaagggggctgaagccagggagccaagtggtctagctcagtggatcccacagccatggagcccagcaagctaagatccactggcttgaaattctcgctgccagcacagcagtctgaagtcaacctgggacactcaagcttggtgggggaaggggcatccgccattactgaggcttgagtaggcagttttcccatcacagtgtaaacaaaggcaccaggaagttcaaactggactaagcccaccacagctcagcaaagcctctctagattcctgctctctcagcagggcatctctgaaagaaaggcagcagccccagtcagggacttatagataaaactatctacaagtttatcaaaaagtttatttaaaagttcctggctgctggctctgaagagagcagcagatctcccagcatagtgctcaaggtctgctaagggacagactgcctcctgaagtaggtccctgacccttgtacctcctgactgggagacacttcacagcagggatcgacagacaccttacacaggagagcttgggctggcattttgcaggtgcccctctgggaagaagcttccagaggaaggaacaggcagcaatcttcactgttctgcagcctctgtgagtgatagtcaggcaaacagggtctggtgtggacctccagcaaactccagcagacctgcagcagaggggcctgactgttagaaggaaaactaacaaacagaaaggaatagtgtcaacatcaacaaaaaggacctccacacagaaaccccatctgatggtcatcaacatcaaagatagataaatccacgaaggtgaggaaaaaccagtgcaaaaaggctgaaaattcctaaaaccagaacaactcttctcctccaaaggatcacaactcctcaccagtaaggaaacaaaactggacggagaatgagcttgacaaattcacagaagtaggcttcagggtgggtaataacaaattcctccaagctaaaggaccatgttctaacccaatgcaagaaagctaagaaccttgaaaaaaggttagaggaattactaactagaataaccagtttagagaagaacataaatgacccgatggagctgaaaaacacaggacaagaacttcgtgaagcatatacaagtatcagtagccgaatggatcaagaggaagaaaggatatcagagattgaaaatcaacttaatgaaataaagcatgaagacaagattagagaaaacagaatgaaaaggaacaaataaagcctccaagaaatacgggactatgtgaaaaaaccaaacctacatttgattggtgtacccgaaagtgacagggagattggaaccaagttggaaaacactcttcaggatattatccaggagaactttcccaacctagcaagacagaccaacactgaaattcaggaaatatagaacacaccactaagatactcctcgagaagaacaaccccaagatacataatcgtcagatcatcaaggttgaaacgaaggaaaaaaatattaagggcagccagagagaaaggtcgggttacccacaaagggaagcccatcagactaacagcagatctctctgcagaaaccctacaagccagaagagactgggggccaatattcaacattcttaaagaaaaaaattttcaacccagagtttcatatccagtcaaattaagcttcaaaagtgaaggagaaataaaatcctttacagacaagcaaatgctgagagattttatcaccaccaggcctgccttacaagagctcctgaaggaagcactaaatatggaaaggaaaaagaagtaccagccactgcaaaaacataccaaattgtaaagaccatcgacactatgaagaaactgcatcaactaacaggcaaaataaccagctagcatcctaatgacaggatcaaattcccacataacaatattaaccttaaatgtaaatgggctaaatgctccaattaaaagacacagactggcaaattggataaagagtcaagacccattagtgtgttgtattcaggagacccatctcacatgcaaagactcacataggctcaaaataaagggatggaggaatatttaccaagaagatggaaagcagaaaaaagcaggggttgcaatcctagtctctgattaaacacacaataaaccaacaaagataaaaaaaaaaaaaagacaaagaaggacattacataatggtaaagggatcaatgcaacaagaagagctaactatcctaaatatatatacacccaatacaggagcacccagactcataaagcaagttcttagagacctacaaagagacttagactcccacacaataatagtgggagactttaacaacccactgtcaatattagacagatcaatgagacagaaaattaacaaggatagtcaggacttgaactcagctctggaccaagcagaactaatagacatctacacaactctccaccccaaatcaacagaatatacattcttctcagcaccacatcgcactcattctaaaattgaccacataattggaagtaaaacactccttagcaaatgcaaaagaagagaaatcatatcaaacagtctcttagaccacagtgcaatcaaattagaatccaagattaagaaactcactcaaaaccgcacaactacataaaaaatgaataacctgttccggaatgattactgggtaaataacaaaattaaggcagaaataaataagttctttgaaaccaatgagaacaaatggagaattgaaatataaataagttgatttatttctttaaataaatagttatacgcacacgcacacacacacacacgcgcacgcacacacacacactcttttcttttttgagaccaagtctcgctctgcatcaggctggagtacggtggcacaatctcggctcactgcatcctctgcctcccaggttcaagcaattctcttgcctcagccccccaagtagctggaattacaggcacacaccaccacgcccagctaatttttgtatttttaatatagatgggatttcgccatgttgccacattgttctcaaactcctgacctcaagtgatctgctggccttggcctcccaaaaatgctgtgattacaggtgtgagccaccgtgctcagccaataaataggtatgttttagcaagatgtagattgagattcctattgagatgtaaaattgcagtatgacacaatacgtacctcagacgaaagctttagttctttctccagtgggtcttgaaggtggcaagaaacatgtattatgaaataaatactccagttcagtgtctctgattattcagatggaatgtaaatgtgtgggaaattgatgggcttggggaaaagtgattataagaagttaggagtatatataaagaaatgaagagctggcagtaggacgtaataggttttgtaactttcctcacttagaaagggtgtaggattggttttagagtttccagcagccccagttttaagggatgtgtcagaagaaccagcttgcatcttgtactccatgatttacactggttagcagtgctaaccagaaagatccaaggaccagaaaattcaactcaagatcctcctgaagattatatacgttcatcctcgtatagaccaatgcctgatgtcaaaatggcattggctggtatagaaaatgcagggttgaaattcataatgactctgaaaaaggagaccctgtatggacaagtgaatgaaaatttataagctctttgagtagtatatttaattcatacacttcctctggaaattggtttgagggtttgaggtcatggatatttagattttaatttgtagggcttaaaagtgaacccctcaagccaaaataatttccatgtgattcagcctaatgtaaaccctggttcagaaagcaatacactaaatatcaaagaattataatatctagtgaatatgtatgaacagaaaccaggacaatatgagtgagagtaaagtgttaagatcaggagatggcagaatgtaagtccagatataagaattcattgccattggagaatttacctaggaataggaatattttttaacttttactttgacgtaatttcacacttaacatgggttggaaaatggtacagagaatctccagattcccaatatgttagaatgttaatgtttttaccacattgctttatcatttaccctctctcttcctctctattcctcctttcctccctctttctttccctacacacacacatgcacattaatttttcttaactgcctgagattaagttggagacataataccatttaaccctaaatacttcagtgtatatttcctaaaatcaaagtcattctcttacacaattatagcacaattaaaacaaaatgagaatattaacattaatacaatgtttttagtaaatctattcaccttaaccagagttaatcagttgtcctaataatcaattgctcctttacactaaaagaaagtcatggatgaaaagttgcataaagttatcacattcatttagcatacttaactgaaatttaacattctggcaaggctacctagagccagtgctaatatttgcttgggatggctccgtgaaggttgatagcctactgtaacccaggtagagatacccgaactgtcttgacatagtacaaaaaagtaagtttaagggattagcattgaattacagtgcaagacgtgaaaacccatcaactgactgtacatccatgtatacaaggagcaacgaaaggcactctattaagtaatgtgctagtgatggaaacactagtatctttgagaggcttagcagtggctgctgtctgtagattggggtcaatgctctattcttccatggaactgggctgtataatatcaatgtggatgttgagattctggaatgccagaggccacatggcaacactgagcccttaaccataattaatatgatgtgcagcaaggctggaatggaaatcacaatgtcttactgcccaggaatctatgacaactgaaaacaggccatggtgttctcaggggtaagatagatgggtagtcaacttgctattcttcaattttattatgattaaaaactagctcttggttatcagaaggttgatatcagatgccacatgcaaaattgctcttcttcgtgcagtttctagatctgagtcagtccacagacccaaaatccattgattcaagttgatgttggttcacttcaagtataaacagtgagtattcctttgatgtttcccccagtgagggcttcagccattttccaagtcaactgtatgctttgtatgctgtgaaaaagggaagaatattcagacttctctagaaatatatatatacatttttttttttgagacaaggtctagctccatcacccagtctggaatgcagtggcgctatctcagctcactgcaacctctgcctcccaggatcaaatggtcctcccacctcagcctcaagtatctgggactcgagttgcacacctcgagtctgggacatagtgcacacctcaagtctgggacatagtggtgcacaccactatgcccagctaatgtttgtattttttgtagagacaaggtttcaccatgatgcccaggctggtctcaaacccccgagctcaagcaatctacccatcttagcctcccaaagtggtgggattacaggagtgagccaccgcacccagcctagaaatattatatatgagatctgaaccgacactatcacagagaatctgaaaagcattttcctttgattagtgtggaggatcatggaatccaggtaagaaatggagttttggctcaagcccatctcataaggggtcaaatggatccccacatctgcactgtggctctttctctggtctttgagtgtataattgaaatgcacattctcaaatgctggaaatcttctctcattattttcctgacctgtgaattaaggactattataataggaacaaccacgtgaaagctccccaaacctccagaaatctaaatcaggaaaaatatcacattgctagaggcactgcaaaacttagtctcaccatcaaaaatttaaaagatgtaaggctagcggacccgatcacatctttctgagtgccctctacaaaatcaggtagttcatgcctcatgagagtggactactataaacttaacaaattgaagtcctgattgaagttgctattctggttgtagtatttttatgaaagatgaaagcagttcaacaaaattgtgggcacttaatataatgctattgatttggcagaatacttttttcttgatgcacatcagcaggaaacattgaaagccattcacttttgcatgtcagagatagcagagtatataccttctcttgcctgaatgctatgttaactctttatttgacataatatcatccattaggacattgaatattttgaaattcctcagaatatcattctgatctgcttcatgttaattgaacctgttgaactagaagtgacaaatatcctagatgcctgagtaagatacatgtgtaccaaaagatgggagataaattctatatttgtcgatctgctatattgttgaaatttttagggatttgcttgtatgccaaaaaggaggtaaataaacttcataaagatccatgggtctgacatattggtgaagttttggcaggatggtcttggatgatactgtgacatttttctaaagtaaggaacaagttgttgctccttatcactctcacgaccaacagagaggaacatttatttggcctcaaaaggaaagtcacaagacagacctccaggactggagaaagaacatgccctccttggtagggaattactctgtttgcagacattttctgctttgttaatatatcctagtcccagctacacgggaggctgaggtaggagaatcacttgaacccgggaggtggaggttgcagtgagccgagatcgcaccacttgccgagatcccaccacttcccaagatcgcacctgttgccgagatcgcacctgttgccaggcactccagcctgggcaacagagcaagactctgtctcaaaatatatatataatataatataacaaaatatatgttatatatgttataaatttaagagtctgtctgaccataacaacatggattctttttcaacaaggttaatccttctgcaattgctgaatgtcccaatcctccagtagtggagacagacaatcaatctccaacatggaaccttacttgccagacacctggtagaatttcaattacatcagactcctttcaattttggaagagcagcaactcatctttatctgaattgatacatactgagatatgtgtttgccttctttgtctgcaaaacccacatcatccccacaatacaagggcttagaaaatgcctaatcttattgacattaaattgtacacaataatttactgtaccaaaaggcccattatattgcaaaggaggtgcaacaatgggctcatgaacaagagaattcctggacttaccatatcactcagaatcagcaagctgaaaagaatggtggactgggaggaggagccaagatggctgaataggaacagctccggtctacagctcccagcgtgagcgacgcagaagacgggtgatttctgcatttccatctgaggtaccaggtgcatctcactagggagtgccagacagtgggcgcaggtcagtgggtgcacacaccgtgtgtgagccgaagccgggcaaggcattgcctcacttgggaagcgcaaggggtcagggagttccctttccgagtcaaagaaaggggtgacggacgcacctggaaaatcaggtcactcccacccgaatactgcgcttttccgaccggcttaaaaaacagcgcaccacaagattatatcccgcacctggctcggagggtcctacgcccacggagtctcgctgattgctagcacagcagtctgagatcaaactgcaaggcggcagcgaggctgggggagggacgcccaccattgcccaggcttgcttaggtaaacaaagcagctgggaagctcgaactgggtggagcccaccacagctcaaggaggcctgcctgcctctgtaggctctacctctgggggcagggcacagacaaacaaaaagacagcagtaacctctgcagactgaaaagtccctgtctgacagctttgaagagagcagaggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaaagtagagcgcctctcctcctccaaaggaacgcagttcctcaccagcaacggaacaaagctggatggagaatgactttgacgagctgagagaagaaggcttcagacgatcaaattactctgagctacaggaggacattcaaaccaaaggcaaagaagttgaaaactttgaaaagaatttagaagaatgtataactagaataaccaatacagagaagtgcttaaaggagctgatggagctgaaaaccaaggctcgagaactacgtgaagaatgcagaagcctcaggagctgatgcgatcaactggaagaaagggtatcagcgatggaagatgaaatgaatgaaatgaagtgagaagggaagtttagagaaaaaagaataaaaagaaatgagcaaagcctccaagaaatatggggctatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtgggggccaatattcaacattcttaaagaaaagaattttcaacccagaatttcatatccagccaaactaagctacataagtgaaggagaaataaaatcctttacagacaagcaaatgctgagagattttgtcaccaccaggcctgccctaaaagagctcctgaaggaagcactaaatatggaaaggaacagccggtaccagccgccgcaaaatcatgccaaaatgtaaagaccatcgagactaggaagaaactgcatcaactaatgagcaaaataaccagctaatatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggaacacccagattcataaagcaagtcctgagtgacctacaaagagacttagactcccacacattaataatgggagactttaacaccccactgtcaacattagacagatccacgagacagaaagtcaacaaggatacccaggaattgaactcagctctgcaccaagcggacctaatagacatctagagaactctccacctcaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatggaaactgaacaacctgcttctcagtgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacattacaattaaaagaactagagaagcaagagcaaacacattcaaaagctagcagaaggcaagaaataactaaaatcggagcagaactgaaggaaatagagacacaaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcaacacatacactctcccaagactaaaccaggaagaagttgaatctctgaatagaccaataacaggatctgaaattgtggcaataatcaatagcttaccaaccaaaaagagtccaggaccagatggattcacagccgaattctatcagaggtgcaaggaggaactagtaccattccttctgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatcctcaataaaatactggcaaaacgaatccagcagcacatccaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcataatgaatgggcaaaaactggagaagcattccctttgaaaacgggcacaagacagggatgccctctctcaccactcctattcaacatagtgttggaagtgctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgatgagcaacttcagcaaagtctcaggatacaaaatcaatgtacaaaaatcacaagcattcttgtacaccaacaacagacaaacagagagccaaatcatgagtgaactcccattcacaattgcttcaaagagaataaaatacctaggaatccaacttacaagggacatgaaggacctcttcaaggagaactacaaaccactgctcaaggaaataaaagaggatacaaacaaatggaagaacattccatgctcatgggtaggaagaatcaatatcgtgaaaatggccatactgcccatggtaatttacagattcaatgccatccccatcaagctaccaatgcctttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaaccaaaacagcatggtaccagtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactgtctagccatatgtagaaagctgaaactggatcccttccttacaccttatacaaaaatcaattcaagatggattaaagacttaaacgttagacctgaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaaccggcaacctacaaaatgggagaaaattttttcaacctactcatctgacaaagggctaatatccagaatctacaatgaactcaaacaaatttacaagaaaaaaacaaacaaccccatgaaaaagtgggcaaaggacatgaacagacacttctcaaaagaagacatttatgcagccaaaaaacacatgaaaaaatgctcatcatcactggccatcacagaaatgcaaatcaaaaccacaatgagataccatctcacaccagttagaatggcaatcattaaaaagtcaggaaacaacaggtgctggagaggttgtggagaaataggaacaattttacactgttggtgggactgtaaactagttcaaccattgtggaagtcagtgtggcgattcctcagggatctagaactagaaataccatttgacccagccatcccattactgggtatatacccaaaggactctaaatcatgctgctataaagacacatgcacacgtatgtttattgcggcattattcacaatagcaaagacttggaaccaacccaaatgtccaacaatgatagactggattaagaaaatgtggcacatatataccatggaatactatgcagccataaaaaatgatgagttcatgtcctttgtagggacatggatgaaattggaaatcatcattctcagtaaactatcgcaagaacaaaaaaccaaacaccgcatattctcactcatagctgggaattgaacaatgagatcacatggacacaggaaggggaatatcacactctggggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataattaaaaaaaaattttaaggaacaatacctattctaggctccctagaaatggaaaaaaaaatttcagagaatagaaaagctttatagctttctcttggcacagattaaatacattaaaataaacaaataaaaaaaggccattaggggaagggtacatttaaaaaaaaaaaaaaagaatggtggactgatgtgttgaagtcttagttaaggtaccagctcagtcataatatcttgtgatgtagtataattaccaaaactgtagcatatatatggtgttttcccgcatagctaaaaaattgaggtccgtataaccccaatgattgtcactgcagtgacccacttgtggaatttgggcttcctcattcctgcaaacataggctatggtggatttgagatactggttttaagagtgagaggtccaggacgggcgcagtggctcatgcctgtaatcccagcactttgggaggctgaggcgggcagatcacctgagatcaggagttcaagacaagcctggccaacatggcgaaaccctgtctctactaaaaatacaaaaattagccgggtgtggtggtgtccacctgtaatcccagctactcgggcagctgaagcagaagaatcgcttgaactcaggaggtggagattgcaatgagccgagatcgtaccactgcactccagcctgggcaaaagaacaagactccgtctcaaacaaacaaacaaaggaagagtgggaggtgcacttccacctgatgacacagtaaatgcttcaatgaaccagaagcctctatcactatcttgcaactttgagctcctgatgcctgtggaataacaagcaaagaaaaattcctatatttacagaggtactcaccctcatttctgtcagcagttaaagttgctgctacatacagagatagggaggattatgtttgaaactcaggggattcactgaagcatttcttagtgcgtctattttcggtgataactgtgaacatccaatttcaccaaccatggcccaaaaagagataggcaactgaatgtttaaacccttctgggatgatcccactagacaagtaacctaaattagccaaggtgtaagctaattgtgaggaaagcataaaaatggtagttgtagccgggcgtggtggctcatgcctgtaatcccagcactttgggaggctgaggcgggcggatcacctgaggtcaagagttcaagaccagcctggccaacatggagaaaccctgtctctactgaaaatacaaaaattagccaggcatggtggcacatgaccgagactgaggcaggagaattgcttgaacctgggaggcggaggttgcggtgagccgagatcgtgccattgcattccagcctgggcaacaaaagcaaaactccgtcaaaaaaaaaaaaaaatggtggttgtagagggagatgagtaatataaactatggtgctgcaatgagaacacatggacacaggaaggggaacatcacacaccggggcctgtagcggggtggggggcaagaggagggagagcattaggacaaatacctaatgcatgtggggcttaaaacctagatgacaggttgatgggtgcagcaaaccaccatggcacatgtatacctatgtaacaaacctgcacattctgcacatgtatcccagaacttaaagtaaattttaaaaaataaaaataaaaaataaatataaatatgtaaacaatatggttctgggacacagtatagtaacaggaactttatgttggcataataatcctcattcaataagcctttttaggagagtgtaactggccaccaatttgaaggattgcttcttcatccaagaaaagaaatgaggacatgttgttctcataaaatgatggctccaaattattgtatcaaggggtagactgcgtcagcctgaatttatacccctattctgtttacacaagaggagtccttggcctgccagacccttggctgcttgctcaaaagagatgtctggctgtcaccactatcactttgtctccaaatatcaacaacgctcatggcctctcctgggctgagatccaaactccctccagcagatccttctttatgcagcttcagcacaaggtctggcttttccacttcttccagcctcaaatgaagtgccattccatacactgcaggatgtgactttccgtggattactggaaatggtgaggtgaaacaatctggaagttcaagagagttaatcagctgaaccaaggtatggtggtttcacagtgcttatctagacatatccaaggcgacggagcagccaactatgttttctcatgaagctgtagaaatctctgtaatgtgctactttatattttctatctcatcccttgccacattgccattttctgtccaaactgctctgtaattgcagccctcaataaacccttagcacaaagctttgcttcaatctctgttttctcaaaaagtcaggcaaagtcacactatgtctcttgatcatcaacaccatattacatttccataggtcacaagcctgaagattgttcctagatgcatccctctcctttctacttttatatctacctccatcacctacccagcaaagtttaagcactgaaatatgatgcacaatggcctctgcgatgcagcttctatatctcttcaaccattcctcttggggttttcctccttatgtggttatctccagctacagtgatctacttgcaggatgttatatgcctccgtctataccttttcctcatgataccaaattcacccatctctgctcacagcatcctcggtgttccctatgttcatttggttaaaaaaaaatgtagctgggtggggtagctcacacctgtaaccccagcactttgggaggccaaggcggacagatcacctgaggtcaggagttcgagaccagcctgaccaacatggtgaaacccagtctctactaaaaatacaaaattagccgggcatggtggcacatgcctgtaatcccagctagtgggggggggggggcgctgaggcaggagaattgcttgaacccaggaggcggaggttgcagtgagctgagatcgcaacattgcactccagccttggcaacaagagcgggagtccatctcaaaaaaattaaaaaatgctacacatcactcaaaatggagctcatgggtcatatcctctatgaagctgtacctaacactcctgctaaatatataaaataaaaaaatacagctaacacttatacagtagtccttactctgtgccatgtactgtcctgagggctttgcatggaatgtgcttacttagttgttaccacaaccccataaatttggtaccattactatctgcatttcacagataaggaagctgaggtgcagaggatttagaacacataggtattctggtgcagatgctcctggactttcttaccattgtaagttgaaaatatcagaaatcaaaatgcattgaatacatctaacctaccgaactccatagcatgcccagaacattgacattaatgtaacattgggaaaaatcatctaacatgaagcctgttttataataaaatgttaaatatctcatataggggtatgagttgtgtaccctcatgatcacattgctgcctgagagccgcagcttgctgctctgcgcagcagggcaagaatctggtaccgcatatcactagcctgggcaaaggtcaaaattcaaaatacggtttccgctaaatccactaagtacgtatcacttttgcatcaccataaagtcaaaaaatcttaagtgaaatcatcgtaaatagaggactatctctatttaaatgaacatctatgctcttcttaatcaccctctcttgcctctccattacactagtcagcctggccgctcatgctgccgtctctatggtcttccatcagagcactaaccatgtttgcatctcttctttgttcatatgtatgcctcttcagtagactgagttgctagagttgaatatgttgatatcattactgtgtgcctagcacagagcacaggatctagtgcagagaaggtatctgataaatgttggataaataaatgttaattaatctggtacaatcttgagaatgacagaacttagacctaagtttgtcattttacaaaacactctcccaagagttatcttcttttgtcctttctatattttggtaagacatttattcttagcaaggattgaataaaaatatttgtacacaaatccctatgctttacctaagtgtatgtattggctcctctggtggtctctctgtgacattaagagacacattggaaacaattacaaattttctcaatcttctgtcccacaagctaggtaaaacacctatatctgtggaattctttagacagataatcaggcttaggcagaattttataggcccaaaattatgttttatcagagtagatacattgcaacagaaaataagattaaacacgccatctaatgtaaagaaaaattatgagttgtactggctaatatatacaaatgtactgggtctccaatagttaaagagaatagtactaagcattgcaaaagtccttacttttaacgttaaagatccttcacctccctcggtaaccctagagcagaagcttttgaaattaccctttgtaatcctcttagcaggatttactaacatttaaatctattacctatatcctttagttgaactgtttaagctcactgaaagtgttattatttttcactcaggcaacttaatggaatgggccagaattaaaatcatcgtcacaacttgaaaatgtgaatgtcacatcctgaaaattaccatctttcatataaacgaacagtcatgcaaacgttgactaaacttctaatatgtactaggcactgtgcctatccagatggaaacaaaataaactccatgtgcatgaggatgctctttaactcaccattgtttacacataaattagcactatgcttggcaagttggagacactcaaaaatactgacagaatatataagtaaaatatgacaaatgcattgtccctgcccttgaaaatattgcagtatacaatatttgagacacacgagaacctatcttgagcccatgggcaagctcatgctccacagttgtgcatgagcatgtgtggagctgcaagtccacctcaggaaagctaattagtataatgggatgtggagagcatgcggtcatgatggaacatgttaagggacacgttctttttaagggttttttttgttttgttttgttttgtttttgacggagtctcactcattcgcccaggctggagtgcaatggtgcgatctcggctcactgcaacctctgcctccagggttcaagtgattctcctgcctcagcctcccagtagctgggattacaggcaccctccaccacacccagctaatttttttgaatttgtagtagagactgggtttcaccatgttggccaggtgggccttgaacccctgacctcaaaagattcacccgcctcggcctcacaaagtgcagggattacaggcatgagccaccgtgcccagcccgggatttcatttctttagtttgtcccttttgagaaaaaaaatcaggttgtgggatgtggaagctgctcatttgtgaagagttcagatcttgcatcttgtagtttgagtcattctgtgaactctgtcactcagagggagatcctagcacagggccatgacatagtaggtgctttgtatgtatagtggagtgaggaaaattgagttaaatgaaatagctgccctcaaactcaggagtcaaagaggaaacgtccaggcaagctctctatcaccatcttgtggtctctaccagcatcttatgcttgtacagtacacccaaccccacattacagaggggaaaagaggtttggtaatagtgtgggggcagaaaaggtcagaaatgttctctaagggcaggactggctcccactttggtgaatctacccaagatttggtgggtacactgacccacaagcaagggccttaggagtccattctctgtttacaaaggcacatctctgggatggaggtaggctgaaaaagtgacttattctgagatatctaggtcatcccaggactagaagaacacagtccaggaaagttcctggcatgtcttcccaatggcaaagctaagcaactggggtgaaggtgagaaattgagtgccacatcacaactgtgtgaaaacaaaaggaggctcctgatctgaaaacggcaagattaggagaacatgtggtcctggtcctgaaacaaaagggacatattgtataaagacttgttatctcaatcctggaatgttacatttgccccacctattcatacacctcaaaaagacagggatgatatattacattttgtttatccatttatcagccataaaaaggaaggaagaaaaaatattgatacatgcgattacataagtggaccttgaaaacatcatgctaagtggaagaacttagaaacaaactgctacgtactgtatgattccatttaagtgaaatacacagaataggtaaattcataaacacagaaaatagtggttgtcaggggctgggagtaggagtcgggaatgagcaataactgtttgatgggtatgaagttttcttttgaggtgatgaaaatgttctggaatgagataatggtgattgttgcaaagctttgtgaatatactaaaaaaaacactaaattgtgcagtctaaaagggtgaacattatcatatgtgatttagatgtcaatttttggaaaagataaaaaagaaaatgtaagacagatacaggaaggaaattccggagcaacatgaatattgtgcacaattctctgtggcaggtgagccattgggaaaccatggagcctgtcactagtcattatcaagtagtatcatatacttgagtgggcacaagatttcctagggaaagcttagctagtgtcacctgggcagcattttctgcgtggtatctgattctgtgctcccaggatcaaagatttatgccagaggggaaagtttttgaccatgaattgagggattagcttctactgtcccagttccaggagaacactacaactccagaaatatactgttaaggcctatctcaaccagtgcatagtaataaaatcaacactaagactttgtagaaaactcagaccaaaaagcagttaccaactgccagacatagttgatgacaccagagatacagtccatagtcaaaacctaggagctcaagatgggaaatgccaagaaaaacagataatgattgaggccttactctgcaggccaagatgacaaattagaatagctaacatacattgggtgcttggttatgtgccaggcattgtcataagtgttttagagatattcatttatttcagcctcacaataacctcatgacataggtacgctatgacaatcctcattgagtacgtaaggaaacctgagcagagagaggttaactaactagctcaaagtcaaaccgctactaagatgtgacaccagtcctcagctaagcctacagtactgttagttgttggcatcaattatgctgaggtcaaaagagcagctgaacccccagtcccctaccacgtggggagggaggcagtaggtacaagaaacacggggacagccaaagacagcgacatccccagcgcctatgctatccatgttattagtggaaatgctcagtcacactgtgcgatctggaaagggagaggactgtaaagggaggagtatcccaggtggcagcagaaagtagtttccagccttcattccttctcacattcctgtgagagatatgggggcgctggttggtcctgggccctaatttcacccattgaacaggaaaaacagccctgaagaggtgacgggtgctgccaagacctctttcgccatctcgtggccactgggacgtatgacacccgacgcagaacctgccaggggggaaactcccaggtgggaggctgagagatgtggggagcaggggctcctaacccggggcttggtaggggaggggaggggaggggaggttctgagaaagcaaaactcctagaatcctctgtatcagcaattctagtgcattttcccgcagctgccataagatccgcagtgggttttggaacacacacaatgtaagggccacagctggagggttgggaagtggtggcaagagaagcctgctcctgttgcgggtggctctggctgagggaactccacccacgagaacttcttggtggagtttaggccgtcttggcatggagaggacaggggcggccccttccctgagagaatcctgttgagccccttaccttttgttggccatcagggcctggcctggggcccccggagtcctccttctgcccagtagcctgggttccctctgagaccaggcccagcccatcatgctctcctttctgccctctggagtaaggccccggtagcctgcctgctcccctctccatagctgccacctcctactccaccctgtgggttcagctgtccctcaggaacatggctgcgaagggggccacagccagcccagctcctcccttgcctgggacccagatggccggccctgacccttcctgatcataaaggcttcactgcgctcctgctctggcagggaggcattcagggcacacacagccgactgacacattcaggggccacaaacagcaaagacactttcagagggttcacagtcaccaccactggcctacaggttcctcccgccttttgactcagagatgccatgtgtaatctctctatatttcagaatagcagccccctcactttgttcctgaccccaatccatcctactatgcactgcttatctgaagcaatatgtattccttctcggcacaacccttatcctcacacttgcttccacctctccttccacccctaacttgacctctatccctgattccaacctaatcccttaccctatgtaaaatcggtgcttcctattatcaaggaaatgaaaaacagacatcttcaaccctcacaaaattcccaatccatcccgtccctaactatgatcctaacactcagaataattgcaaaaatcctgcattgtggacacacctgaccttcactaaccccatctctgactctcacttgatccctgactgctaccaagacccctttcacctatagatcactctttttctacattcacgtgattgccaaagcacacatccctggtttcatcctgtcattggtcctgaccatctttaactgtcagcaactagtagacacacacctaatcctttatcctttttaatgccaatgattatgtgcttatcaagtaacataagtaatattcccaaactttaatccgtccctaaccatcatcctatttaaaattattctttttattaagttatggggacacaactttgttccataaatggaaacaagaaaaaaatcatcattttaggagaatgagatgagagttgaggttgtttgtttgtttttgagatggagtttcactctgtcgcccaggctggagtgcaatggcgtgatctaggctcactgcgacctccgcctcccctcccaggttcaagcaattctcctgcctcagcctccccagtaggtgggattataggcacccaccaccacgcccggctaatttttatatttttagtagaggtagggtttctccatgttggccaggctggtctgaaactcctgacctcaggtgatccgccagcctgggcctctcaaagtgctggaattacaggcatgagccaccatgcccggccgagagtagaaattttaatgaatgagagagacagagagagtatgtgtaggggagttcccgctttcttcctctctcctcctttctctaccgcccaactcatcctcaccttctctgcgaattctaactgtcctttgtcatttagcaccctcatcttccaaagtctggctgcagaggaggtacaatagccactccccactcccgcccccctttgagaccccagatggccagcacctagaaagttcttattttgagaatgtgactattgaccctgcaggacaacattctgagcataaaagcactatcagatgcagaaaaaagggtttaaaagaacctaacagaggtcgcaaaaccaacatcttgggtcataggttccgtagtttccaacttcattttgatggcaggatagtcctgacccaaaatcccagtggtctctcgcatgctcctctatttcccctcctctcaccttgctgtcttttaagaaatcaagactggaagatacacagtagtgagaagatgtccaggaggtgcccccttgattctgtggtctgggaggtcctccagaaagggtgaaccttcatgcccacccacgcaccccggctccaaccccatttcctaggcctctgcctttcactgaggaatgatttccactggtttcctgtaaggccatgtcgcagatacggttagaacttgtgtctggatctcattctactctgcttctggggcctggcctgacatgaaatgctaatctggtccggcttatgtttatgtcagtgaagccatcctcatgaagaggacgtgcacattagaccacagtggggtttctagaacatgtcctgtccctacataggagaaactatgggtcaaggtatctttggtcctagatgcagagaatagcagactctttctgtaaaaggcctgatggtgaatgatttaagctatgcaagccacaggtggcctcggtcacatagcctccattttttcaagcaaagctttaaaaatgtaaaaatcactcttagctttcaggccttacaaatacaagtcactggccacatctgttctgtgagttagcttgccaacccctggctagacattcattctcacctctcaaatccatcaaagccctccctcctctcctgggctttccatagcacaagtgcaggtttataatgaatttcctcaccatgagtacctgaaaagagactatggaattgagttttgtgtacactgtgagggagaagtaaagtttcatttgcacgcacggatgcccagtaatcccaagaccactcattgaaaactcagtcattcccccacagaattgaaatgctgcagctatcatatatcacatgttttattttaaaagctatggctttctcatcagtgactatggaggctacaggacagtgtcacgtcctcttgaaagtgctgatgggaaaaaaaatcaacccagagttctccatccttgaaaatatcttcacagatgaaggtgaaataaatgttttcagacaaaagacaactaagattctttgtcactggtaggcatacaataaaataaatgctataggacattcttcaggttgaagaaaactacatcaggggaaaatacagatcttccagagccagaacatgttccagagtaaagaacatcagaaatgttcagtgtctgagaatgtacaaaataaattttcacttagttcctttaaaatatacttgaacgcttaaagcaaaagttctaacatcattttgctgtgtttataatgtatgtacataaattacaaatgacaataatagtataaaggacactaaggaatagtaaaagtatgtatattgttataaagattttacattctgtatgaggtggtagaatataaactctaagtacattataaaaagttaaggacacatttcaccatgttggccaggatggtctcgatctcctgaccttgtgatatgcccaccttggccgcccaaattcctgggattacaggggtgagccaccgggtctggccagcttccctactttatgaggttttgggactcggaatggcttcctggctcctcagcttgcagatggcctattgtggcacttcaccttgtgaccgtgtgagccaattctcttaataaactccccttcatatattcatctatcctgttagttctgtcccactaaagaaccctgactaatagatatgccacattttgtttattcacacacctggcaatggaaatttggatttttttccagatcgaggctgcaataaataatgctactacaaatatttgtgtatgtctttgtgcagacatatattttcatttcccttggatagtgtcacatttagaatgtgtcccccaaaattcatatgttgaaacgtaatcaatagtatgatagtattgagaggtggggcctttaggaaataattaagtcacaaaagaagagccccagggacagaattagggcctttatgaaatgatttgagggaatgggttcatcccttcctgttgcttccaccatgtgaggacacagcatttatcccttccagaagatgcagcaacaaggcaacagcttggaaggtgagagactggaccctcgcctgataccaaacctgccagtatcttgatctggaactttccagcctccaaaactgtgagaaataaatttctattgcttataaattacccagtctgtggtattttgttatagaagcgtgagtggcttaggacaggtaaataccttaaagaagactagctgggtcatatcttgagtttatgttttctttttaaagaaattgctcatgcctgtaatcccagcactttgggacgccaaggcaggcagatcacttgaggtcaggagttcgagaccagcctggccaacatggcaaaaccccgtctctactaaaaatacaaaaactagccagtcatggtggcgggcgcctgtagtcccagctacgtgggaggctgagacaggagaattggaaggctgagacaggagaatcgctcaaacctgggagatagagttgcagtgagccaagatcatgccattgcactccagcctgggcaacagagcagtactgtctcaagaaagaaaaagaaagaaagaaaggaaggaaggaaggaaggaaggaaggaaggaaggaaggaaggaaggaaggaaggaaggaaggaaggaaggagagagagagagagagagagagagagggaggaagagacagagagagagagagagagggagagggagagagagagagagagagaaagaaagagagaaagaaagaaagaaaaatagtcaagcttttttccaaaatggtgaaaaaattttacattctcactggcatgtctgaaatttccagtgtctctacaccgtcaaaaatgtgaaattgtctggttttcttattatagccattgtaatgagtgtagttttattaccttatggtttcaatttgcatttttttaatggccaatgatgtttgggcatattttcatgtatttttatacatgcatgtatcttctttagtaaagtatctattaaatatttggctcattgttatgaactgaatgcctcctaaatttgaatcttgtagcctaattcccaatatgatgatatttggaggtgagcctctgggagttagttcatgagggtagagccctcaggaatgggattggtgtctgagacgagacatgacaaagattatctctctcttagccatgtgagaatatagtaagatggaaactgtctctaagtcaggaaacaggccctcaccagacaccagttttgctgtcaccttgatcttagacttctcagcctccagaacggtgaggaatgaatgcatgttgtttaagccacccagtctatggtatttttgttacagcaaatctacctattttaatttttttaattattattgagttttgaaagttctttatagaagaacttgcatacaagtcctctaacaaatatgttttagaaatatttgtataagccatggcttacattttcattctattaacagtgtcttttgaaaagcagaattttataattttaactatgtccaatccaatttgtcaatcttttgtttatggattagcctaatccaaaaacaaagattttcccccatttccttctagaagttttctagtttttgctcatatactagggtctgtgtggccaggtgtggtgactcacacctgtaatcccagcgctttgggacgcctaggcgggtggatcacctgaggtcaggagttcgagaccagcctggccaaaatggtgaaacctcgtctctactaataatacaaaaattagctgggcgtggtggcacatgcttgtaatcccagctacttgggaggctgaggcaggagaatcacttaaacccgggaggcagaggttgcagtgagctgagatcacaccactgcactccagcctgggtgacagagcgagactgtctcaaaaaaaaaaaaaaaaagttaaggtctgtgatccgttctgaggtaacctttatgtgtgattatgtgaggtaacggtttaagttcacttgttgcatacggatagccaaatgttccagcaccaatccctgagatcctcttttttcttaatgatttgtgctaatatctttgccaaaaatcaaatgaatacagatgcaaggatttatttctgtactctccattctgttccatttatgtatatgcctatacttttgccaattctctactgtcctgattactatggtcttatggtaagttttgcaatcagttagcatatctttcaactttgtacttttgcaaaaattgttttggctattctaggttatttgcatttccatataaatttgaaaatcatcctatcaatttctattggaattttgatggggattgatttgaatttataaataaatttaggtacaattgccatcttgacaataatgagcatttcgatttataaacatagaatgtgtctctgttcattgccttctttggcttccatcaacagtgttctctcaactatagttcatggacaagtcttgtgcttcttttgtcaattttttttttattttgagacagagtctcactctgtctcccaggctagagtgcagtggcatgatcttggctcactgaaacctctgctgcactggttcaagctattctcctgcctcagcctccccagtagctgggattacaggcacctgccactgcacccggctcttttgtcaattttaaccctaagtatttttttcttgttgatgctgtggtgaatggcattgtatttttaattcaattttctgattaattgctagtatatagaaatatcaattttgtatattgatattgtgtgatgtaaatttataaaactcaattactagttctagtagttttcatgcattccttgatgttttctagaaaaaaaaaaggcagttttaatacttcctttctaatccagatgcatttaatgtctctttttgaacttgattgcactggctaaaaaatccagtaaaacgttaaaagagaagtggcaaaagtgaacatctgtgccttgttagtaatcttaggagggaggaaacaatacatttcttcaacattacatatgatgttagccctgggtttctcatggatgccctttatcaatttgaggaagtcttctgctcctagtttgttgaggctatttatcataaatgtgtgttccatttttataaatacttttatgcatctactgagaaaattatgtgattttaatcctatgttctactaacattgtgcagtacttagttgacttttgaatattaaaccaacctggttttcatgggattaatcccacttggtcatgacatataatcctatttatatgttgttggattaagtttactaatattttaagtgttatatccatgaccatgaaggatataaagggtctatagtcttctgttattctgatgtctttttctggttttggtgtcagaataatactggcttcacaggatgaatcagaagtgttttctcagcctctatttctgaaacagttgtgaagcactggcattatttcttttaaaaatatttaatagaattcaccagcgaagccaactgggttgggatttttcttagtgtaagtatttttgattattaatatatttacttctgtcgtaggtctagtcagattttttacggttttttgtttgtttgtttgtttgtttgttttttctgagatggcgccctgctcttgtcgcccaggctggagtgcaatggcacggtttcggctcactgcaacctctgcctcctgggtttaagtgattctcttgcttcagcctcccgagtagctgggattacaggcacctgccaccacacctggcaaatttttttttttctttttttgtatttttagtagagatggggtttcagcatgttggccaggctggtctccaactcccaacctcaggtgatccgcccaccttggcctcccaaagtgctggaattacaggtgtgagccactgcacccagccagatttttaatttattcttaaataagttttaataatttgtgtcctttgagaaatctgaccacgtcatctaagttgtgtaattttctgtcatgttcataatattcccttacaatccttttaatttatgtgggatcagtagtatcccaatgtcccattttcatcactgattttgataatttgtgcctgttctcttttttaaatttcttttaaagagattgcggaggggggtctcaccctgttgctcagactggaatgcagtgaggtgattgtagctcactaaagtctcagactcctgggcccaagtaattctttgcctcagcctaccacatagctgggactacaggcacgtgccaccatgcctggctaatttttaaattttttgtagagacagggtcttcatttgttacccaggctggtctcgaactcctggcttcaagtgatcctgctgccttagcctccaaaagtgtgttttttcccttggacttttaaataaatatttttttggcagggcgtgatggctcgcacctgtaatcccagcactttgggaggccaaggggggcagatctcttgaggtcaggagtttgagaccagcctggccaacacggtgaaaccccgtctctactaaaaatccaaaaattagccaggtgtggtggcacgcactggtagtcccagctattcaggaggctgaggcaggagaatctcttgaacccgggaggtggaggttgcagttagctgagatcatgccattgtactccagcctgggtgacagagcgagactccatctcaaaataaataaataaatatttttcaatttttgtatttttttcatagaatgaattttgatgttattgactttcttctcttgttttactgttttctatttctttcatttctattctagtcttactgatttactttcttctgcttgttttggacctagtttgcttttctttttctagcttctaaaagggcaaatgaggtttgaaatcattcttttctgatatagagtttaaacctataaatatctttgttattgacttagctgcagtcaataaattttgatatgttgttttaaatttcattctactaaaaatatctcctaatttactttatgatttcttccttgacccatcccatttgttattcagaactatgatgtataattccgtggaatttatggatatccagattttattcttttattattttctaatttacttccattcatactttgtaagacaggaatctttaaatttcctgaggcttgttttatggtccatcacatgttctgtcataatgatccatgtgtacatgaaaagcgggtgtataccacaggcttgtgtgaagtgattttatacatcagttaggtgaagctagttgatgttgtcttttcaagtgttatatatttttgctggttttctgtccacttgctctaccagttattgagaatgaggaataaaaatgccccccgtccctttttttttttttttttccggatggagtctcgctctgttgcccaggctggagtgcaatggcacaaacttggctcactacaacctccacctcctgggttcaagtgattctcctgcctcagcctcctgagtagcttggattacaggtgcctgccaccatgcctagctaatttttgaatttttagtggagatggggtttcaccatgttggccaggctggtcctgaactcctgacctcaggtgatccacccgtctctgcctcccaaaatgttaagattacaggtgtgagccactgcacccagcaaaatgccccattattattgctgaattgtgtggtccttcttttatttatggcacttcttgctttatgtattttgaagctttgttgcaagcatgtatacatttataattgatctagcttctggatatattaactctgacactattatgtaatttttatctgtgtattccataatattcttatcatgaagccttgccataaatctatttcttcagatattaatgtagccactccagctttcttatgattaccattgacaccatatatcttttttccatccttttactttcaacctatttgggtgttgatttaagactcatctcctgtaggtagtataaactcagatcttgcttttttatccacctaatgatctccatcttttaattttggtgtttaaattactaaaatttaatgtagtttttgatatagttgaatctaaatttgccatttgggtatttggtttctatatatctcccgtctggatttgttcctctgttccagattgactgcattcttttgtgttcagtaaatatttttaacttttcactatatattcactaaatatttttatgtaccactttaacttctctttgaatttttaattatgcttttgatttattttaatagttgttctaagggttacaatatacattttaacctatcagaatatacatcagcttaatactaacttacttcaagtaaaacatagaaactttgctcatatttatttccaaacccctccaacattggtctgttatcatataaattacagttatatattttaaaaccaacagtacaatgtaataattattacttcacataatcttaggtcatttagataatatagaaaaaatgaaaaaacaatacatagagtcttttttatattaacccagctatttaccatttcctgtgcccttcatttattcttgtggattcaagtcaccatatagagtcatttccttttagactgaaggactgtttttagttatttcttgtaatacaagtttgctagtaaggaattttatcagtctttatttcaccttggcagaatgtccctatagatggacctaggaaagagaaatacggaagcagccacaggccagaccaaaacagggtttgtattagtgcatttttgcattgctattaagaactacctgagactgtgtaatctataaataacttatagattgtagctaaggaagttgttacaaagatatttataggtttaaagactaaagacgtttaattgacttacacttccacagtctgtacaggaagcatggctgtggaggcctcaggaaacttacaatcatggtagaaggcaaaggggaagcaggcaggttttacatggccagagaaggaggaagagagcagggggagatgctacacacttttaaacaaccagatctcacgagaactcactcactacatgagaacagcaagggggaaatccacccccatgatccaatcacttcccaccaggcccctcctccaacactgagggtcacaattgcacaagagatttcagcagtgacacaaatcaaaaccgtatcagagttcaaactttcttgcccaaagtttaacattgttgtgcacatttaatttccagagcacagaaatggttggttttgtccatttcatagttgttctttggcgagaggatttcccaacatcttcacatggtcacttgagaaacgcctttctcaaacataatctttcatgttttatgaaaaaagtcaacaaaaaagccaaactctgtaaaatattgaaaaatgtttattctgcacaaaatacgactgaccatggcgcaaggcacagtctcaagacgtcctgaccaaggtggttgggttacagctttcttttctatgttttagagagacagaagacatcaatcaatacatgtgaggtatacattggtttggtgcagaagggtaggacaacttaaagcaggggaaagtgggtgcttacaggtcataggaagatgccaaggttttctgtttggcaattgcttggaggagttaagttattttctaaagacctggaatcaatagaaaggagtgtctgggttaacataaggggttgtggagaccaaggtttttattacatagatgaagtctcataagtggctgcccttagagataataaatggtgaatgtttcctatgtagactttaaaaggtgctagaatctcagttaatctcttcaggtttaggagggcctggaaggggaaagatctagttatgttaaggagatgctttacagatgcaaaatttccccaactgccttgcagggccatttcaaaatatgtcaaagaaatctattttgggggtaaaatatttttatttccttttttatcatgtgaagttatacctgagtcaggttgaaatttggtatcttattgctacaaagaatctgttttgtcagttttaagatctgttttaatgtcaattgtcatggcctgaactagttttcaggattctttagaatccccttggcagatgaatggaggggaattcagttgattgggggagttagaatttgatttttctggtcaggattgagcagaggaggccaagcgtggtggctcacacctgtaatcccagcactttgggaggccaaggcaggcagatcacctgaagtcaggagttcgagactagcctggccaacattgcgaaaccccatctctactaaaaatactaaaattaggccaggcacagtggctcacgcctataatcccatcactttgggaggccgaggcaggtggatcacgaggtcaggagttcgagactagcctgactaacatggcgaaaccccatctctacaaaaaaatacaaaaattagctgggcctggtggtgcatgcctataatcccagctactcaggaggctgaggcaggagaatcacttgaacccgggaaatggaggttgcagtgaaccgagattgtgccactgcactccagcctgaatgacagagtgagactctgtctcaaaaaaaaaaaaaaaaaattagccaggtgtggtggtgcacgcctgtaataccagccatttgggaggctgaagcaagagaatcacttgaacccaggaagcaaaggttgcagtcagcctagaacgcaccactgcactccagcttgggcaacagagcaagacttcgtcaaaaaaaaaaaaaaaatttcccagaggcaacatcaatggccaaactatcattttgttgcataccattgctggggtggtgtggctatgtgccctgggtctatcctatcccttggtggggactcacggccaacagatgtagagccaaaagacttatagccaatttaaatatcctaggccagatgggaatggaagtggagcaggcatttatcaaaccttaaaattttgtaatgtaagcatcaagaaccaaaagtcaaaaggcaaggttacaaaattgacttagctataaattctacgcattaagctagaatatcctcacttggccacttgagaagtgtctttctcaaacattttacattttatgaaaaagccaacaagaaaaacccaactctgtaaaatatttttaaaattttattctcagccaaatatgagtgaccatggcccaaggcacagtctccagaggtcctgagaacatgtgtccaaggtgattggtttacaacttggttttatatattttagggagacctaagacatcagtcaatacatgttttagttatagacttgtagcaattagcttgcaaaagataagtactttgttaaaactttttaagctacagaatttagagacttttgttgtgtcacaacgcttttagcagtctttttaatagtttgtcctaaggtgcttgatttaaaaaaactttatataacaatctgcataaatctcataactgggagcactatacccaggaggttttcttaccagaaaagttcatatcctctttgcaattttcttttaattctacaggaaagaggaaattatggttgggatggatgaaaaaggaccacatactggtccaggaggtaaagtatcttattttgccaactgtttgggcatctgtgtgcccattttttatttggaagatctaaattaattttgttgctcaaaaatcaacctttacaatcttacacatttacctcttccaagatagtgcctgagcctagagggaagatgcttatatagttttagcagtggagcattagcattgaaaatagatcgggcccagtgggattctgaatagttttaaatttcagagatattaagcagagagagagtgaaaaagtaacctttgttgttttatccaattttgcaagctatgtatagagttagtaatgtttaaacgaaagggacttaagccctgcctagctctgacaatggcaggaaaagaaaactcacaggtaactaaacatttatctagtaaggcatagaacaaattatattaagatagatagatgaaacattattcaatgattacttatgcctttgtatataggcctggtccagtgtcacatgaaagcagttcattttgactgtcatcttctcccaggtctgaagatggaactttggtcaacttgaatttgatgccagatatcaatattgactattaagattcagtaggcgtcaggattccctttcagatgagatacatgtacccaggagtcaaagccctgcaacttaacagcacaagggttagttaataacatttcataaagaccttttttaagtggggctagagggagtctctcaactgatgtctaatcatcaggctggtggtggtgatactggagtttatgacttgttggcagctgtggaaagattctatatccttatagtgattaatttttatagttttaataagcctccagcaataagtcaagtcagagacttaatttgggatttgattttgaggatatttgtcaaaaatgttaaaagtctcaaaatattttattaaaacagaaccatacaacattataaaataatagttaatcatttaacaagagtcacaatcaaaagacttcaacaacaatataggaagttacacaaatataaaaacattaaccctttcaaagtttgttttttaagtattttttaaaacctaattaaaacaacacaggaattattttgataaaatgtaaaatcactgttccttacgctaatcaccaaaaaagtaaaacaacaacaacaaaaaagacctatggtagcaattatttttccttatgggaagcttatttgaataacctgaaagtcaaacctgcatcccaggacttctcaaagacagaaaggctaaaaacagcagagtacagcagaatttgaacttctaagataatctcagaaatttcaagtttaaaaaagaattacataattaaaatttaaaaatttcttgcaatttcattgaataaatcaatattttaagaaaatctagtctaccaaaactttagttttatattagtgtatttttagtatcaaagcacaatttctagaagatgattaaataatttcctttccagtatagccaacttaatcacacacaaaatttcttttataaattctgttttttacaaaccctattatgactttcacatactatttatgacatgcttgaactttctgttttattctaggacaaaaatttatcatacaagattctttttcacacaaaattattttccttttaaactctattaccaaaaaatactgcttttatagctatagctttctttacatttcttttacttactatcagctcattttaccctgtttcaaagtaacccttgaattagacaaaaattatttacttttattaagaacacatttttatgtcttataatttttcttattttcatcagaatatatctttttttggcatgttttacatgtagaattatatattaaattcaatttttatttttagtaaccttacttttttgtgaagacctagtaaataggaaatcttaaattgtttatcacatgagcattttatagatgaaaaccattttataattaatttgtttgaaaatgtttttgtatatataatcttttaaaacaattggatatgacccacatatttaataattatctcttatttaacttaacataactttaagaatttaaaattacaggacaagtttatttataaacatttattccattgcatttatttgactatttatttatttttaatattttacctagagtacttatgaaaactgtgatgttagacaaagctagtcattatttaaagttatttctctgttaaccaattttacagcatgtgaatatcaggtgtttaactaagtatgaaatttacagttaaataaatgtttttttttttttgctgataactcaggatttatctgttttcattagaccaacaatattaaatgccttatttatcaaaaattacacaaagatcatagatttggggctgagtttatacttctatatcctttgtgccaaactttaacaccttataaaatatctataagagataaacacaaaaccacctgaccagtaaatctagacaaaatgtgtgctgacaattctgaagacatttctaattttattttaccaataattttaaagtcagcttatttgttaaagatttacttaagtcacatgaactagaaaagcactgggcttatttacttaatttatgagtactcctttattgtaaagccaatttggtactttgtggtcacaacacattaaaaaaaatggatgtacgtacatacaaacacatctaaacacatacacacacatacaaacaaagatcttatagcttttatttcagaactctaaccatgagataaatacaaactcaccagtttgaaaaaaaaaaagaaagaaaaagaaatggttggatgcagacagtggtttttatctcaactccagtagaaaagtaacaacagatttaaagcaggcagaaaagaaaatagagaaatacacataaaactttaaagactctatattcgcaggttgacttttgacctctgaatttttcttgatgtaatttagccacaagtttaaaatgtgcccaagaatagaccataatatgtaaccagctggagtattagaaaacctggcatgccttcaaacttttccatttacacaaatgcttgcaagtagaggcatcataaaaccaaacaacgtgcccaaaagggggttgttatctttgtatctcctcattctttgattatttgtttccctttttttaattttctttaagggaggaaccaaactgtagtctgcgtttcaatggagtggagctgagaagttcagtctctcgttgattcacacaagggacagttcagtttctcaagcaaatgcacaaacaagccaagtgagattaatttggggagaaagaggcaatggaaaagatccttcagaatgctttctgaatcaaaattaggatcctgaacaacaacttcctaggaaaagaaccagctcagaataaagcagaagactgtcaactgagcaggaggttcagggctgaggaggacttaccagtttcactcaagaagaagcttggagttggggggctttcaatgggcccctgctggtaccttagctctgggtttgggtgactctttcagggttctgagtcttctctgaggccccatatgtagggtgccaattaatattgactaaaaaagccaaactgtaacatatgtgaagaggtttattctaagccaaatatgagtagccatggcccaaggcatggtctcaagaggtcctgagaacatgtgctcaaggtggttgggctacagctttcttttctatgttttagagagacataagacatcaatcaatacatgtgaggtatccattggtttggtctagaagggcaggacgacttaaagcaggggaaagtgggtgcttacaggtcataggaggattccaagattttctgattggcaattgcttgaaagagttaagttattttctaaagacctggaatcaatagaaaagaatgactgggttaacataaggggttgtggagaccaaggtttttattacatagatgaagtctcataagtggctgcccttagagataatagatagcaaatgttttctatttagacttttaaaaggtgctagattctcagttaatctcttcaggtttcggaaggcctggaagaggaaagatctagttatgttaatgagatgctttacagatgcaaatgtttctcaatggctctgcaggtccatttcaaaatagggccaaaaaacatactttggggtaaaatatttttatttccatttttatcatgtgaagttatactagagtcaggttggactttggtatcttattgctacaaagaatctgttttgtcagtgttaagatctgttttttttctttgtttttgtttgtttgttttgagaagtggtctcactttgtcacccaggctgaaatgcagtggcacaatctcagctcactgcaacctctgcctcccaggctcaagcgattctcctgcctcagcctcccaagttgctaggactaaggtgtatgtcaccatgcctagctaatttttgtatttttgcagagacaggatttcaccatgttgcccaggctattcttgaactcctgacttcaagggatacgcccacctcagcctcccaaagtgttgacattataggcatgagccacctcaccaggccaagatctgttttaatgttcatgctggtcagttatgcctgaaatccaaatgggagagggtataatgaggcatgtctgaccacctacttccttccctttatggccttaactagtttttcaggtttctttggaatctctttggcagaagtgtgggatccattcagtcaactggggggttagaattgcatttttggtcatgaaacttgaccttgaaagttattttatgaatatgaaccattttcttttttttattattatactttaagttttgggatacatgtgcagaatatgcaggtttgttacataggtatacacatgccatggtggtttgtggcactcatcaacctgccgtctacattaggtatttcttctaatgctatccctcccctagtcccccaccactgacaggccccaatgtgtgatgttcccctccctgtgtccacgtgttctcattgatcaactcccacttatgagtgataacattcagtgtttggttttctgttcctgtgttagtttgctgagaatgatggtttccagcttcattcatgtccctgcaaaagacatgaactcatccttttttgtggctgcatagtattccatggtgtatatgtgccacattttctgtatccagtctatcatcaatgggcatttaggttggttccaagtctttgctattgtgaacattgccgcaataaacatatgtatacgtgtgcatgtgtctttgtagtagaatgattgatcatcctttgggtatatacccagtaatgggattactgggtcaaatggaatttctgattctagatccttaaggaatcgacacactcttccacaatggttgaactaacttacactcccaccaacaatgtaaaagctttcctatttctccacattatctccagcatctgttgtttcctgactttttaatgattgccaaatacctaatgactttttaatgatggccccaaatacctaatcctgatggtaatggtattaagaggtaaggcctatgggaggtgatttggtcatgaggctctacccccatgaatgggattagtatccttaaaaatgtggcctgagggagctcttttacttctactaccatatgaggacatagctagaaggtgccatctttgaagcagagattgagccctcattgttcaccacattttctggcaccttaatgttcgaaatccctgactccaggactctcagtaaattacgtttttaaaaactacccagtccaagttacattgttatagcaccctgaaagaatcaaggtataaattgatagcaagaagtggtgtgctgctctaacaaatacctacaaatgcggatgcagcttgggaactaggtaatgggtagaggccgtaagaatgcaaaggatcaggctagaaaaagcctacatttctgtgagcagagtgttaagagtgatctggttatggctcagaagaggagagctgtaaacaatgcctaatcttcttagagatttcctaagaggtcatgaacagaattttggtataaatctggatggtaaaggccattctgatgaagtctcaggtgaaaatgagaaatgttatcagaaactggaggaaaagccatccctcttataaagtggcaaataacctggctgaactgtgtatgtatcctagggctttgcagaaggtagaacttctgagcaatgatagtatagttagtgaaataaatatctaagcaaagtgttgagggtgtgttatggcctctcttgaatgcttgtagtaaaatacaagaagatagaaacaaattaaaaagaatttataatcaaaagggaagcagaatgtaaagatctgaaaaattttcagtgtggctatgttgtgaagagttaatgaaaaagcatattcagaagagaatactaaaggtatgaccaagccaccatttgataagaagattagtagggatagaaggaaggcagatgctattctgcatgacaataagagaatgaccctaaaggcatttcagagaccatccagcctgccactcacatcacaggctcagaataccaaacctggggcgtaaaatgaggtcaaaagagggaccttgggcatccaaggaacctcagtgcttgctgccctgaactacctcaagtctctgctccctacattctggcacagcatttttcagctccctctctcatcagatgtgtctcaaatgggcccagatgtggttcaggccaccactctaaagtgcacaggcagtaaaaatcttggcagcatcaacacagtgccatctccacaggagcacagagcaaaatgagctgtagagacatggctacctccacctatattactaagggtactcccagagagctgcagggcatggacaaagatgtcccacaggaataggactacaataaagagtcaccattggggcaatgtctattaaagccatggagggaccaccataaaggcaaagtctggtaaaaccatgagggcagggccatcccagagacctcagattggtaaagccaccagtgtgcaactccagcctaggacaaccacaaacacaagactccaacacatgagcactgtggcacgggctatgcacagaaaagtcattgggaatgggaccagttaaagccttgggggcccaatcctcatccaagtgtgtgtgaaaggcacaacactgagtcaaagaagattattctccagccttaagttttaatattgtttgtgctcttgggttttagacttccttgaaacatattaccccttttcctttcttctctctcccttatggaatgggaatttctaacttatgcctgtcccaccactgtattttggaaacataaaacttgtttaacttcaaaagctcagagtagaaggggaatttggctcagaatgaatgataccttgagtctcacccaaatctaacgtagatgatatttagatgagactttgaactttaaacttttgagttgatgcaaaaacaggttaagaatttgggggctattgacgggcacggtggctcacgcctgtaatcccaacactttgggaagccaaggtgggtggatcacgaggtcaggagttcaagaccagcctggccaacatattgaaaccccgtctatactaaaaatacaaaaattacccaggcatagtggcacacgcctgtagtcccagctactcaggaggctgaggcacgagaatcacttgagcctgggaggtggaggttgcagcgagccaagattgcaccactgcactccagcctgggtaacagagtgagactccgtctcaggaaaaaaaaaaaaaaaaaaaaaaagaatttgggggctattaggataggatgaatatattttgcatgtgggaaagacacaaatttggggggcccaagggtgggaaggtatgttctaaaagtctgtatcccccaaaatttatatgttgaaacctaacccccaaggtgatattattaagagatgtagcctttggaagctgattagataatggagggtcagtcatactgaatgggattagttccctaataaaacagacgtgagagagcttgtcacctcttctgccatgtgagcatatagatagaaggtgccatctttgaagcagagagtgagccttcaacagataatgaatgtgctggggccttgatcttggacttcccagacaccacaactgtgagcagtaagttttattatttataaaagattataaatcacctagctatggtattttgctacagcagcctgaatggactaaaataaggctgatatattttactgataatttcaaagaatctgtttaaaattcattgattattaatttttggctttctattcctgtgatttcactttcaaaatgattgaatcaattcttctcatttgcttggattaattatttgtttattaacatttggtaagattagttcattcttttcggtcttattaccttaattttcaaaactgttttatataacacttggttgagcttatgataataaataaataaataaacattttaataaagtcattaatggataaaggctttcctctgagaaaagcatctgcaggcataataggatttgacttgatgtattttgcctttaattattctctggatattatgtaagttccctttttatttcctatttgagtaaaagagaatcttaaacgtgtttattaatttcagattggataagattttggtaatgtttctttacttccaaatttattgaatagacaaatgatatggatggataaatgcttactattttaatacattaaatgattttaagccaaaagactgataaacctattaaaaattctcattcttgccgggcacagtggctcacacctgtaatcccagcactttaggaggccaaggtgggcggatcacttgaggtcaggagtttgagactagcctggccaacatggggaaaccccgtctctactaaaaaatacaaaaataggccggcgtggtggcaggcacctgtaatctcacctactcagggggctgaggcaggagaatcacttgaacctgggaggttggaggttgcggtgagccaagatcaggccactatactccagcctgggcgacagagccagaagtccatctcaaaaaaaaaaaaaaaaaaacaaaactcattctctaattgtgagatgtaaagtgttatatttaatacgtaaattgtgtttattgattgaataattcagttctttatgtcttttacaggaatttaaagactgatttatgcataaaacaagagaatcagaagtattaaatttaatcagtgcttattatggcatggtccatttatatcagtgtttttctttttgagagtatttccttattttctgaatccatgtataaataaaagctattttctactaaaaaaaaaccatggtaacatggatcaataaataatacagatcaaagcagaactaaacaaaatagagatgaaaaaccaacacaaaggatcaacaaaatgaaaaattggttctttgaaaatataaacaaaactgctgggcgcgatggctcactcctgtaatcccagcacttcgggaggccaagacgggtgaatcacttgaggtcaggagttcgagatcagcgtggccaaaatggtgaaatctcatctctactagaaataaaaaaagtagccaggcatggtggcgcacgcctgtaaactcagctactagggaggctgaggcacaagaatcgcttgaacccaggagatggaggttgcagtgagccaagatcacaccactgcactccagcctgggtgacagttttatatttatatatatatatacacacacacacacacatatgaacctgataaaccactagctagactaaccaagaaaagaacagacccaaataaacaaaatcagaaatggcaaaggagagattaccactgataccacagaaatacaaaagatcatcagagagtattatgaacgactatacactaacgaactggaaaacctagaatatgcagtctatatatacaaaatggaatactcttcagccattaaaaaaatgaaatgatgtatttgcagcaacttggatggaactgaagatcattatgttaagtgaaataagccaggcacagaaaggaaaatatagctctcattcatctgtaggagctaaaatacttgttggcatggaggtggagcgtggaatgatagataccagagacaggaaagggtgtatttgcgggagggcagtggggctgaagagagttggttaatgcgtagaaacatacagttagaaaaaataagttctaaactttgatagaagagtaaggtgactataatcaacacttttctgtagttttaaaatagctggaagaaaggacttgaaatgtacccaacacatagaaatgataaatactttgttgataggtaacttaaatatcatgaattgattattacacattgtatgcatgtaacaaaatttcacatgtacccttaaatatatacaaatataatgtatcaaaaaattaaaaatagaaaattaagaaaataaataataaattaaaaagcttaaaatatggaaagtaaaaagctgtttaatagtattgaaaagtgcttctgttgcaatcttaaatgaggtccacagcaagcatacattactttttttgtttttttaagtgtctgttatggaaggagagtatagaaatgtgttactctctgtaaggcaatttctgtaatatacaaattatgcctaactacctctattggctatgcttagaaaaggattgtggcagaccaattctccctgacaatcacacagacaggcctgcatgacagtcacacaggcaggcctgcatagcacctcagttacacagacaaatttctacagagtggccttaacattgagcaaatagtttaaccgagggaaatcgatgcccagacatcaaagctagaaataaaacatatggtcaaggccgggggcggtggctcacgcctataatcccagcgctttgggaggccaaggagggcagatcacctgaggccaggagttcgaaaccagcctgaccaatatggagaaactctaactctactagaaatacaaaattagccgggcgtggtggcgcatgcctgtaatcccagctactcgggaggctgaggcaggagaatcgcttgagtccgggaggcggatgttgcagtgagcggagatcgcgccattgcactccagcctgggcaacaacagcgaaactccgtctcaaaaaacaaaagaaaagaaagaaacatatggtcagtaggaaccttgcatgggcttctctggaacaagccaaaagaatggagacagtcttacattcctagtgccaggacccatcttgggtcaatgaaatctgagacgagtcaaggtaacagaggcagctgcattggagagtccaaggcagctctccggaccaagctgtaaaggagataagatagaaataatcattccggtaccacagtagacaggctttgaaggtactggggcccttttaattggacttagcaagcattttttttgcctctgacattctagttgaagcaaatttagttaccaatagacataggcgaatgctatattgcagtaggcacataaccccaacctatataagcactaagaaaattgtaacactttgagttggtctggtggaattatctccagcgttcttcctgtatccagttacagcaataaattcctgtgtttcctagtttgcctgcttttccgtactaggcctctagaaaatgcagcgggccgggcttcgttcctggaacaggagtaactcccaaacaagtattagtgtaggactgaaaataaatgcagactatcttgagagtctcaaaggaaaatagggtggctagagaggcctttctctaagtcttgaacttctagcattttattctctctcttaagcttggagacttcacacttatcctttcaggtagaaaatctgatactatgggaaagtactggatatagaatgttgagcagaactgcacagattgcatataatgaaagcagaactccatagacaaagtcaggtgtcaattaaatttctgaaataacaatattcctgatgagggtgagtggttttaggtctcagtttgattcacatggaaaacaaaagcggaagttgagtagtaaggcaaggttgcccccaaactggacaaaacataaggcagccatgtttgccggagttttttcagacacgaggggcgggagaagagggatctagacacggcttcttggcgtttctggagcactactgccatcgtgaggatgaagtttcatgaaaccctacgccattacactgttctcgaattctggagaacagtatttttctctctgttggggaaattctgatctgtgggaaggaggaagaggcgtggggctccaagctaggtcttcttgccttctcctctaagaccttaagatagacctggacattggcggtatcttggtgtagaacctggagagtgaggacttagaatgaaccagcccctgccgggcggtcctggcacagaaagtcgtggggcggggcctcggttcctcctctgggcaggactgcaggaacccgctcaaagacaaatgcaggctcttgtgggcatctgtctcctgttcctgccccttggagcaaaagtcagtaggttttcacatggtattatcttactacgggtctttggctctcttgtggcatcagtatccgcgcacaataaacaacgttcttccaggggaggtttacaggatttgctcttagaaccttcactctccaggttctataccaaggtaccgccaatgtccaggtctcttttaaagcctcaaacgagactaagcaaggactcccagcatggaggcgaaccctcttccaccttttaccagaccacacctgccccaacaggtagtcctcactagaactctttaatggcgtagggtttcgttaaacgatatcctcacgatggcagtagagctccagatatgccaataaacctcaccttggaggactctactcccgctcttcttgtgtgaaaaaacgccacccatagacaaaggcgccaccaaacatgggtgccttgtattttgccttctttgggtccacctggtcttactgctgcacttttgcttttgttttgtttttgcttttgtttttgtttttcttttgagacggagtctcgctctgtcgcccagggtggagtgcagtggcacgatctcagctcactgcaacctctgcctcccgggttcaagcaatcctcctgcctcagcctcccaagtaactgtgattacaggcaccgcacccaagtcgagctaatttttgtatttgtagtagagacgaggtttcaccatgttagccaggttgatcacgaactcctgacctcaggtgatccgcctgcctcggcctcccaaagtgctgtgattacagacgtgagccaccccacctggccttgcttttgtcttccgtttgaaatcaaaccaaactctaaaccatgcaccctcgtcaagaatcttattatttcagaaattaaatgtcttcttgatctagtctatatgggtatgatttacgttacagaattatatgtccagtactttccaaggcatcaaactgtctccttcaggggataaattcaatggatgagggcacaaaaaggagaaagttgctagaagcttagagattttcgctggcaaacaatttacaaatcctggtggtctctgttctggctcccctcccagacaaccagggagttcttcatgttgtagctcatgtgttgcattgtaggcaacaatgtggcatgcatgaatcatagagaagggaccagatagctgtcattactgcatgtcaaatatgttccgcatggcaagatactcatagtacatatgttcaattcctgtccaggttactcagtgtttcatctcggggtctcatcatctaacatcaaaacacagcatgttcccatgccattacatattcttcaggtatttcctgagactttatggtgtgtgtgtgtgtatgtgtgtgtgtgtgtctgtctgcattttataatttgtcttttaggtataatgtttacagtattctcccactaattaattaaaaaataatggctgccaaagattcggaaaaatccacatactactaaagaagaaaaacactaccatacaacgtgtcaaggcaactaaccttttggatcatttctgtgtatatctttcaatatatatatacattcttgatttcatgtaaaaaataaatctgtattaaaactggattataggctgggcacggtggctcacacctgtaatcccagcactttgggaggccaaggtgggcggatcacctgaggtcaggagttcgtgatcaacccggccaacacagtgaaacttcatctctactaaaaatacaaaacttagcgggcacctgtaatcccagctactcaggaggctggggcaggacaatcacttgaacctgggaggcagagggtgcagtgagccaagatcatgccactgcactccagcctgggcgacagagggaaactttgtctcaaaaacaaaacaaaacaaaacaaaaaaactggattacattgtacattgtggattgaatcagaccaagtatgtatgttaacaaaggtttgaggagcatgaattaatttgaatgtcatcaatattatatgtcaacattttaagccttcattataaacaaaggtaaatcttaaactatgccctcgaaaacattgctttagaaaagtagacactattttttgtttgaatttttacagatacatcacaatgtgcatattggctctctagaacacatacatgattatatatttggtttaaggttatcacattttagaagtagagtaaaatatactttactttgtcatttaccgtgtggaagggtttaatcctcaaggttcaataatttacttttctcactaaatcagacacagggaatggctgcttatgaggacatagaatgcaattaagattttgtgaggactaaagggattacctggtgcagatgaatgacatgtatccaacctaaatgggaatgataggctcattgcccctccacactatcctcccttgcagaagaaaccaatcaacctcctgtcactaccactgggattcagctaggtgtgatttccttaccaggcttctatccactgcctaggcacacagcctctattaaagatagttagcaaggaatgaataaacaattctttagcctaaggaattctaggtctgagaccagcaacttttctagctttgttacactaagtagctagtcaggtataagcagagcaggtgaggctctccccacccaccaggaatgtcaggcgaccatcaggtgatagtcaagcagttgtcacactgcctctctaaaataataactgggtgcaccctgcaccaagaagcagtttcccaatagataaaaacacctgaaattggtaatcagcagcttccagtaagatctcaggaattggtcaagtgggcttcacattaagaggcaaaatggtggaatttaactggtatatggccttccagggatattgcacggtaaagggaagaatgcctcacctgagcacgtgtacagcttcagtaaatacactgcgcatgcaggcagcctgccgcaatggaagaatcaaaagaaaagggacacaagatgccggaagtaggccaccatataaaatcctaggtccaaggtcaaacggagcacttgaccaagatgtctgcttggccctcttccaagtgtactttactttcttttcatttctgctctaaagcttttgaataaacatcactcctgctctaaaactttccttggtctcttcttctgccttatgcccctcagtcggattctttcttctcagaaggcaggaatcgaggttgctccagacctgtttggattcaacgctggtagcacagataacttcaaccgctaatatatttatacaaacacaacccaaagaaagccaaacaccatttcatagttgacagtgtttactgtatgattgttataccaaataggccaaatatatcatgtttggacttcagaggacttaatatctaaactagtaattatgtcagaaaaaaatataatttataatttaattttggaagctttgtcaaatatcaatggtttaaaacacttgatattataaaatcaaatcccaggtcaccatgagtcatttaattagccaaaacaataactcaaaatgttttaaaacggaaaaaacctttactcattaagagggagacttagctctccaaacaatctgtctttttttctttcccttcttcttcctacagtttattcaaaaggcaaacaaaaatctttcatcatttcttaatatcacatgaaaatcttgttcaagagagaaagccaaatttcaccattgtattagtgcactattgatgtcaaacccaaatcttaatgaaaccttatggacaaatctatccaattttaatgtctgaccataaggtaagattcttataaatcttttataattctttgccaatttttgttaaagagcaaattagtgctgtaagaaaactctgttgtactttttttttttttttttgagacggagtcttgctctgtcgcccaggctggagtgtaatggtgctatctcggctcactgcaacctccactttccaggttcaagcaattctcctgcctcagcctcctgagtagctgggattacaggcgcccgccaccacacccagctaatttttgtatttttaatagagatggggtttcaccatgttggtcaggctggtctcgaacccctgacctcgtgatccacctgcctcagcctcccaaagtgctaggattacaggtgtgagccaccatgcccagccaactctgttgtacttttattccaatgttcaatttatggaaaaattaaatagtacccctttaactttagctaatatgttcacacacagaatttcatttacaattaatttgtcacaagccttccataagtgttcaaaccttcagatttttctacctaacttaaaacattattattttagagaggcagtgtgacaactgtttgactaccgcctgatggtcagctgacattcccagtgggtcggcaagagccctctcctgccctgctcatatctgactagcgacctactataactgcttcagatatgggacactgtctcatatgtagggctgctctcttccacaaaaatggtcagaccaagctatttctccaggaggtagtttagcagtccccagcctttttagcatcagggatcggttttgtggaagataaattttgcacagtccaaggttggggatggtttcagttagattcaagctcactacattaatcatgcactttatttctattgttattacactgtaatatataatgaaataattatacaactcaccataatgtagaatcagtaggcaccctgagccttgttttcctgcaactagatgatcccatctgggggtcatgagagacagtgacagatcatcaggcattagattttcataaggatagcccaacctagatccttgcatgaacagttcacaataggattcatgctcctatgagactctaatgttgccaatgctgacaagaggtggaactcaggcggtaatgcaaacgatggggagtggctttaaatatcagtgaaactttgcctgctccacgctcacctcctgctatgcagcccagttcctaagagaccacagaacagtacaggtccgtggcccaggaactggagacccttgatctagcagatatctaagtctacgttaggtgaaacagcgtggggagtctagatgtcattttgtcatttccaggaatgggggtcattgagaaatgcttcccagagggtcgttaagacacttctatttttgttttgttttgttttgttttgagacagggtttcactttgtctcccaggaagaagtgcactgttgcccactgcaaccttgacctgcagggctcaagcaatccccccagcttagcctcctaagtagctgggattatgggcaggcactaccgtgcccagctaattttgtggggatttttatacagacagagcttcaccatgttacccaagctggtctcaaactcctgagctcaagcaatccacctgcctcagcctcccaaactgctaggattgcaggcatgagccaccgggcctggccgaatctttaaaacattcctgaatgccaatagcatctatgtctacagaccatcaatcaactctaaccagcttgagggagagctaggtacagtcaaggatgtcacaaaagccaggtcccttaccctggaatgcctgcctgaatcttcagaggccaggagaagtcctacctgaagaagatcttgaagcactggaaggtcacactacagtaccagactaatattacatccttttttaaaagattcagatactgagataacaaacaatgaaaaagaatgtcatggggaacaagtcacccatacaattttagccacccttgttgatttttcaattatgagtcatggagtatctggaggtctccacacctaagggtggatatcttcatgaagaactagctttgaagctggtacacagaacgctcgctagaatgagataaatactggtttcctcaggactaaaaaatgccatcattctcagggaatgtccaacggaaaagagccacctatctgccctccttgagagaactgagattaccatcagtgtcctagtatgagaaaagacattcccatgaacttataaagtcacagataatcctggcttgtgggcttagataattgcttaggctttccattacattcttgcttcctggaagcagctagctcagtcctggtccctcactcaccagatacttcactaagactttgcatttgtccattgattgtgccaggcctcagagaaaagggtaggaatgccaacttgtgtcttgggcctgttcagcctccactggcttttccttccgcgacggctagggtttacgtggaggaaatgctcacggcttcggatgctatgaaactacttccgcatgatggcagtattgtcccagaaaagccaagtagcgctaggcgctcctctcccgcccatcacgtttgaaaaaaatgccatgaagggacaaagacaacagaaactaaaactatctaacatttttgctcaacttgcataaatgtattccactcttggcattttgcttttggcttccattgttttttttgtttttgttttttcttttcacagacggagtttcgcacttgttgcccaggctgaagtgcagtggctcagtcttggctcacggaaacttccgccgcccgggttcaagtaactctcctgcctcagcctcccaagtagctgggattacagggacgcaccaccacgcccggctagtttttgtatttttagtagagacgggtttcaccatgttgaccaggatggtcgtgaactcctgacctcaggtgatccacccacttcggcctcccaaagttctgggattacaggtgtgagccaccgcgtctggccccatcggatattaaactgagatctaatccactcaccctcatcaagcatctcctgttttcaagaactcagtattggccagccaggattgctccagtgcactccagcctgggtgacagaataagagtcgggctcaaaaaaaagaaaagaaaaagaaagaaaaaaagaaaagaaaagaaaaagaactcagtatccgcacaaccaagtctttccctttctgctttttcactcagcatcatatctgaagggttttattgtgatatcgaattgtcttgtaatattagggacagacctcagggatccatgcctacggaaacaaacaaacaaaaaagcaacaacaaatgtttacccctaaggtcttggagaatagcaaagctaagcaccaggccatgtggttcttgtcctgaccctctgtcaggcctctgagcccaagctaagccatcatatcccctgtgacctgcacgtacacatccagatggccggttcctgccttaactgatgacattccaccacaaaagaagtgaaaatggcctgttcctgccttaactgatgacattgtcttgtgaaattccttttcttggctcatcctggctcaaaaagctcccctactgagcaccttggagcaccttgtgaccccgactctgcccgccagagaacaactcccctttgactataattttcctttatctacccaaatcctataaaacagccccacctttatctcccttccctgactctcttttcagactcagcccgcctgcgcccaggtgaaataaacagccatgttgctcacacaaagcctgtttagtggtctcttcacacggacgtgcatgaaattttgtgccatgactcggatcaggggacctcccttgggatatcaatcccttgtcctcctgctctttgctccatgaaaaagatccacttacaacctcaggtcctcagaccaactagcccaaggaacatctcaccaattttaaatcgggtaagcggcctctttttactcacttctccaacctccctcactatccctcaacctctttctcctttcaatcttggtgccacactttaatctctcccttctcttaatttcaattcctttcattttctggtagagacaaaggagacacgttttatccatggacccaaaactccagcgccggtcatggactagggaaggcagccttccattagtgtttaatcattgcagggacacctctctgattattcacccaggtttcagaggtgtcagaccactcaaggacacctgccttggtctttcacccttagcggcaagtcccgcttttctaggggaggggcaagtaccccaaccccttctctccgtgtctctaccccttctccgcctttctgggtggcaagaaacctccaaccccttctccttcactcttagcagcaagtcccacttttctgggggaggggcaagtaccccaaccttgtatctctgtgccccgatcccttctttccatgctccgacctcttatatctctgcaccccgatcccttatttctgcaccccaacctcttatatctctgtgccctgatcccttatttccatgccccgacctcatatctctgcgcctcaacccctttcccgcttttctggaggttaagaacccccgaaccacttccctacgtgtctctactctcccttttctttaaacttgcctccttcactataggcaaccttccaccctccattcctccttcttctcccttagcctgtgttcttaagaacataaaacctcttcaactcttgcctgacctaaaacctaaatgccttattttcttccacaatgccgcttgaccccaatacaaactcgacagtggttctaaatggccagaaaacggcactttcgatttctccatcctacaagatctaaataattcttgccgtaaaataggcaaacggtctgaggtgcctgacgtccaggcattcttttacacatcggtcccttcctagtctctgttcccagtgtaactagtcccaaatcttccttctttccctcccacctgttccctcagtcccaaccccaagcgtcactgagtctttctaatcttccttttctacagacccatctgacctctcccctcctcgccaggccgagctaggtcccaattcttcctctgcctccgctcttccaccctataatccttctaccacctcccctcctcacacccggtccagcttacagtttagttccgcgactagttcttccccacctgcccaacaatttcctcttaaaaaggtggctgaagctaaaagcatagtcaaagttaatgctcctttttctttatccaacctctcccaaatcagttagcgtttaggctctttcatcaaatctgaaaaacccagcccagttcatggctcgttcggcagcaaccctgagacgctttacagccctagaccctaaaaggtcaaaaggccatcttattctcaatatacgttttattacccaatccactcctgacattaaataaaactccaaaaattaaattccggccctcaaaccccacaacaggagttaattaacctcaccttcaaggtgtacaataatacaatagaggcagccaagtagcgacgtatttctgagttgcaattccttgcctccactgtgagacaaaccccagccacatctccagcacacaagaactccaaatgcccgaaccgcagctgccaggggttcctccagaacctcctcccccaggagcttgctacaagtgccggaaatctggccactgggccaaggaatgcccacagcccgggattcctcctaagccgcatcccatctgtgtgggaccccactgaaaattggactgttcaactcacttggcaaccactcccagagcccctggaactctggcccaaggctctgtgactgactccttcccagatcttctccacttagcagctgaagactgacactgcccaatcgcctcggaagcctacaggaccatcacagacgctctaggtaactctcacagtggagggtaagtctgtccccttcttaatcaatatggaggctacccactccacattatcttcttttcaagggcctgtttcccttacctccataattgttgtgggtattgatggccaggcttctaaacctcttaaaactccccaactctggtgccaacttaaacaatactcttttaagcactcctttttagttatccccacctgcccagttcccttattaggccgagacactttaactaaattatctgcttccctgactattcctaggctacagccacacctcattgctgccttttcccccagttcaaagcctccttcacatcctccccttgtatctccccaccttaacccacaagtataagacacctctactccctccttagcaaccgatcacgcaccccttaccatcccattaaaacctaatcacccttaccctgctcatcgccaatatcccatcccacagcacgttttaaaaggattaaagcctgttatcactcgcctgctacagcatgggcttctaaaacctataaactctccttacaattcccccattttacctgtccaaaaaccggacaagtcttacaggttagttcaggatctgcgccttatcaaccaaattgttttgcctatccaccccgtggtgccaaatccatatactctcctatcctcagtacctccctctacaacccattattctgttctagatctcaaacatgctttctttactgttcccctgcacccctcgtcccagcctctctttgccttcacttagactgaccctgacacccattaggctcagcaaattacctgggctgtactgctgcaaggcttcacagacagcccccattacttcagtcaagcccaaatttcatcctcatctgttacctatctcagcataattctcatgaaaacacacctgctctccctgctgatcgtatccgattaatctcccaaacctcgatcccttacaaaacaacaattcctttccttcctaggcttggttagtgcggtcagaattcttacacaagagccaggaccgcaccctgtagcctttctgtccaaacaacttgaccttactgttttagcctagccctcatgtctgcgtgctgcggctgccgctgctttaatacttttagaggccctaaaaatcacaagctatgctcaactcactctctacatttctcataacttccaaaatctattttcttcctctatctgacgcatatactttctgctccccggctccttcagctgtactcactctttgttaggtcccacaattaccattgttcctggcccggacttcaatccggcctcccacattattcctgataccacacctgacccccatgactgtatctctctgatccacctgacattcaccccatttccccatatttccttctttcctgttcctcaccctgatcacgcttgatttactgatggcagttccaccaggcctaatcaccacacaccagcaaaggcaggctatgctatagtacaagccactagcccgcctcctagaacctctcattttctttccatcgtggaaatctatcctcaaggaaataacttctcagtgttccatctgctattctactactcctcagggattattcaggccccctgccttccctacacatcaagctccaggatttgcccctgcccaggactggcaaattagctttactcaatatgcccgaggcaggaaactaaaatacctcttagtctaagtagacactttcactgaataagtaaaggcctttcctacagggtctgagaaggccaccgtagtcatttcttcccttctgtcagacataattcctcagtttggccttcccacctctatacagtccgatagcagaccggcctttattaatcaaatcagccaagcattttttcaggctcttagtattcagtgaaacctttatatcccttacagtcctcagtcttcaggaaaagtagaacagactaatgatcttttaaaaacacacctcaccaagctcagccaccaacttaaaaaggactggacaatacttttaccactttcccttctcagaagtcagacctgtcctcagaatgctacaaggtacagcccatttgagctcctgtatagacactcctttttattaggccccagtctcatccagacaccagaccaacttagactgtgcccccaaaaaacttgtcatccctactatcttctgtctagtcatactcctattcaccgttctcaactactcatacatgccctgatcttgtttacactgctgtttctccaagccatcgcagctgatatctcctggtgctatccccaaactgccactctaaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaaccgtatccaggccatcaccaataattctacacgacaaatgtttcttctaacaaccccacaatatcaccccttaccacaaaatcttccttcagcttaatctctcccactctaggttcccacgccgcccctaatcccgctcaaaggagccctgagaaacattgcccattgtctctccataccatcccccaaaattttcgctgtcccaagactttaccactatttcattttatttttcttattaatataagaagacaggaatgtcaggcctctgagcccaaactaagccatcatatcccctgtgacctgcacgtacacacacagatggccagttcctgccttaactgatgacattccaccacaaaagaagtgaaaatggcctgttcctgccttaactgatgacattgtcttgtgaaattccttttcctggctcatcctggctcaaaaagcttccctactgagcaccttatgatccccactctgcccgccagagaacaactcccctttgactataattttcctttatctacccaaatcctataaaacggccccacccttgtctcccttccctgactattttcggactcagcccgcctgcacccaggtgaaataaacagccatgttgctcacacaaagcctgtttggtggtctcttcacacggacgtgcatgaaactctctacccaggttccctgggagttctactctatgttctgacctagacattaggtcttacgtgttgaggggaaggccgctattgctaattagtggagctctaagataagggtccacataactcttaaacttgacagacacaacccttcttgaatgtacacaaatacaggaatgactataaatgctaatcagatggatcgcaggattttgtctcatggtttcattatttaatattggtacagaaatattttccagtgtcatgaaatggcaatggcttaagaccgtgtcctatgactttgctgtgtatgtgtcttattgtttttccgttaggattcaatcctatattttctcattagtagaaaagacgtggaatttgcaaagaagtaaaaagaaactatgtgctgatcaaaagaaaagcaatgtcataaaactgtgtattaaatactgataactttttccatattttgtcccactttcaatacatagataaaagttctacatatatgtatgcaaacactacaataaatttacatttaaattggatttagctatacgtcatgttttagagtgaacattttcacatgtgattcttgaacagtttttgacattgttataaaaaaatttgcaatatctggattttaaacaataaaatatttgcaaagaattacttgattgaacaagtcgttaagaagttcttggccaagtacagtgactcacacctgtaatcctagcactttgggaggccgagatgggcggattgcctgagctcaggagttcaagaccagcctgggcaacatggtgagacgccgtctctactaaaatacaaaaaaaaacccagccaggagtggtgcgggcgcctgtaatcccagctacgcgggaggctgaggcacaagaattgctttaacccaggaggcagaggttgcggtgagccaggactgtgccactgcactccagcctgtgcaacaaaatgaaaatctaaaaatctacctatacatacatgaacacatatataaatacatattacatataatataaatatatattatacatacttatacctcagaattagcttttaattcttctcaaatttttatccctaattcttatcttaaattttatctttaaaatctcaaaagaaatataacaaaattccataaatgatagttgagataggcatctctcacattcagtcacctagatgtgtaacctaagaaaactttaagatggaagtattcacaccactcacatgcagctacaatgtttcattaatgtgtgtcttaatataaatatgaatgatataaatttgttggccaatactatcatattcaaacatgtactcactataacactgaccatgatttaaaatatatggcattaggccaggcatgatggctcacaactgtaatcccagcactttgggaggccgaggtgggcagatcacatgaggtcaagagttcaagaccagcctggccaacgtggtgaaaccctgtctttactaaaaattcaaaaattagctgggcgtggtggcaggtgcctgtagtcccagctacttgggaggctgaggcaggagaatcgcttgatcctgggaggtggaggttgcagtgagccgagatagcaacactgcactccagcctgggcaacagagtgagactgtctcaaaaaaaataataaaaaatgaaataaaaatatatggcattggccaggtgcggtggctcacaactgtaatcccagcagtttgggagactgaggcaggtggatcacttgagcccaagagttcgagaccagcccaggcaatgtagtgagaccctggctctacaaaaaatagccaggcacggtggtgtgtatctgtagttcaagttacttggaagtctgagttgggaggattacgtcagcgcagggaggtcgatgatgcagtgagccacgatcatgccactgtactccagtctgggtgatagggtgagagcctgtctaaaaaatatatatatatgtcattttaaaactgtgtatacatacagacagatatgatgcagatacacagtcccacacacattttactttcaatataattcaatgcatactgtttgcaattttgtacaaaatctttagaacaccttataatatctgcatgaatccatatcaatatatacttttgagggcttgagatttttggattttactctagaagaactttaagaaattataattcaaaaagtatatggtaggtcaaacatagtgagacgaagtaatttaaaatgtctgggccatatattatcatctgttgacgatgcacatataatatgaacttataagccaatgttcaaattatcctgtagtgtaactattaaaacaagttatcttcacttacaaattaagtacttttcaaatataataattaattattcttggaaataataataggttttaaaatattggcactttttagaactgagttatgctaaattctttccttattgtactctactggctaaggaacaaaaaggctcacccggcctccagttatacagttcatggctattcttataaagttcatagaaggctctagagggaacgcatgtaaagcggcaccggtgcccacctaagtaacgccagagacgtctggaactctaagtttggaccccacaggaggatgctctggaagatcctccgtgcctcaaattctccaaagaggatgctttctgcagaggttctaaggtctagtattaagccctccttggaattttctctcagagttgtaatgttccttggccccaaaattgtttagaatctgaagtttattgtctaatgggaaagccggatggtgttgcatgtaaccgggcttttgtgctgctgttctaagtagggggcctcgttaacgtgtgatgccttcctttgttagtttggccccagtgatccttattggagtctggggaggtttagactttaaaaatcaaactgccatggagactgcttacccgaaattttggttcacagccttcattggattatctgttggggcaaagtaaaactggcaagcttgtattgctatctcatggctaaagttgcaagctattggagcctgcagctcccacgcaaggggaagaggaggaagtcctcccctacaaagcgaattcacaaacttgaaagaagcaatttacacaggatgtgcagatctcaacggaaggacaccggaaacatcaaaagcaaggaaacgggatacttccaaaggaacccagtaattctccagcaacagatccctatccaaaagaaattcaagaaatgtcagatagagaattgtgcatactgattttaaccaagattaggggatacaagagacttctgaaaaagaaaggagcgaaatgacagaagcaattctggatatggttgaggtaattaccaaccagatacggagttttccagggcacacagcaaatgtggaactgaagaaatcataggatgaaatacaaagtacactcaaaagcttcaatgatagactagatcaagcagaaaaaaccctcagaacttaaaatctgaaagcctttttctcaattcaaagatttaaagggttgtactctggccattcacgtgaacaaaatctgctgggttaattggtttggttttttttcctttttttgagagggagtctcactctgtcacccagactagagtgcagtggcacgatctcggctcactgctatctccacctcccaggttcaagcaattctctggcctcagcctcttgagtacctgggattacaggcacctgccaccaagcccagctaattttttgtattttcagtagagatggggtttcaccatcttggccaggctggtcttgaactcctgacctcatgatccacccgcctcagcctcccaaagtgctgggattacaggcatgagccaccgtgctcagccactgggttaattgttatagtggggtcttggataatcactaaaggtgaaataaaaattaaaaaaagtatattggtggaataaaaatagaaaagccttcagaattgttgacatacattttgtctgaattttgtttgtctttgccagatattttatttatttatttatttatttatttatttatttatttatttattgagatggcgttctctattgcccaggctgcaacgcaatggtgcgatctctgctcactgcaacctctgcctcccaggttcaagcaattctcctgtctcatcctcccaagtagctgggattacaggtgcctgctaccacgcttagttatttttgtatttttagtagagatggggtttcaccatgttggccaggctggtctggaacttgcgacctcaggtgatctgtggccttggcctcccactgtctttgctggatattttaaaatgtcagtgttaattcaagctgggggcttgggctgagcctgcctcccattccattcaaagtctcactgagataaatgcatatctgattgcttcctttggaaaaggtaatcacaaactcaaaggatgcaaccctttgtctcccacctgtgatctaaaatctcccaagccgcctcctctccagttgtcctgtcttgtttgttttacatatgttgattgatgtctcatgtctcccttattaaaaggaaaaataagtacggtgaatgaggtaaatgttttagataaatttttgtgtaaattaaaatcttaaagttatttttgatcctcatttaatatctgggtcatttccaattaagacagggttgtgatacggggaaacatgtttctaaaattgtggaattgttcttatctataaatgcctatatctgatagttcagaatttattgctgtttagggtttcactgacattttacgttactaaggataaaaattttagttaacaagtaattttgtatgcaaaatgggccagaaagggttacgttattagtggaaaaataataattttgtctaattcagaagttatctaaattttgttcaaattacagttttgaaaagattatttatgaaacaatgtagtaaggaatcattataagtagggaagaaagttgtggaaaagtttaattaataaaatattctttaaaacctgagagaattggagacatttggctaatgaacattctcatagttaaagttcttagtcttgattaaagtaaaataagaagtattatacaaatgtatcagcaacctggagcagtggctcacgcctttaatctcagccctttgggaggccaaggcgggtggattacctgaggtcgggagttcaagaccagcctgaccaacatggagaaatcccatctctaccaaaaatacaaaattagccgggcatggtggtgcatgcctgtaatcccagctactcgggaggctaaggcaggggaatcacttgcacccgggaggcagaggtttcggtgagccaagatcgtgccattgcactccagcctggccaacaagagtgaaactccgtctcaaaaaaaaaaaaaaaaaaaaaagtatcagcagtttgacaattttttttaaaatataggtaagcatgaagctggaattagtgtggagccaatttcacatatatgcttgcattgcttcacactatgttgaggtggcatctgccaccatgccaggctaattttgtatttttggtagagacggggtttctccatgttggtcaggctggtcttgaactccccacctcaggtgatccacctgccttggcctcccaaagtgtgagattacaggcgtgagccaccacgccatttgacatggatactgttggagtacatattggtcatgtgcctaaagtaaatttcttaattgtacagaatatataatgatattggtgaacttaagggtattgaattgtgtatcaggaattaatggagcacaccagctttttatccataaactaactttttggattttaggcttcctgatactctaaatgtgttgagtatactctcacaaatagaatttgagtcatatttctctctctctggctaatttctccaaatttgtaaactatgaatattcttaattcatggcaatgtgtttccttgcatacagtcaagcatggtcaccagggccactcagggagagacaatccagaaacctggcatgcagccaaaagggtaagaattttttaccagtcagtctctggcctctatctctgtgtgcaaactcgttaatctcctctgaaattttaaattactttgtttaataataaaaagaacttaaatcaaatattttgtcagaaaagtagagtgtaatgccttttagttcacataactttagcaatctttgggatataaagatggttttatagattattggtaggagaggtgtggtggctcatgcctgtaatcccatcgctttgggagcccgaggcaggcggatcacctgaggtcaggagttcgagagcagcctggccaacatggtgaaaccccgtctctactaaaaatacaaaaattagcagggtgtggtggcgggagcccgtaatcccaactactcaggaggctgagacaggagaattgcttgaacccaggaggcagaggttgtggtgagccgagattgtgccattgcactccagcctgggcaacaagagggaaactctgtctcaaaaaaaaaaaaaaaactgttggtcagatgcaaggtttgctaagtgttttaatgttacaaactgctttttgggttttgagaactgtctgtcttgcctgcttcacacttggtgacacctggggacatatgaaactaaccacacccttaactaagaaggcaaggcttgactgcacttagcatacaagtaaagcaacttaccgtgttttaccttaagggtaaaattgctaggaattaattgaaactactagaaatagatttacatgcaaggtgtgtaaaaacagtaaaatgtatttttatagtaaaaggttaaatgaaggcatggaaatgtcaagttttgcctagggttaaaggattgttttgagttaaattaggaaaaagctgaaggttcaaagaagtggtggaagaattgtggaaattagtcttgctgaagaggttctctgtgtgaacatgttgactaaattcaaaagggttataaaaggtttttgcttctttaaaatttctgagctatcattttggcaaaataaataacttgtagtaatctggaattcccaaaatcaaacttcagtttcaaaattgtcttccctggcacctgccttttggaatacttcagagggtccctgaagtgtccagaaaagagaggtaaacaggattaggtacatggtattaaatacagtgagttctaaatttttcttcaaagaatcagtatgtcagtatgttcagttctttgttccccattttaaagtttaacttcctcattctcctcgtctccttgcccctggtttcagtaaatgaccttttccatcagttctaatcagtagttcacacctgttcccctggtcacctgctccatcctgagtcacccctggttacccgctctgatctgtcacatttagtcatgtgttccgtaaccatccttcccaccaaaactgctcaccccgccattctggtcatacccctgctctctttaaaatagccaatcagaattagcttagactgtgcagtccaaccctagcctatagggcaacgacacagcagtaggggctacctgcatcagggataagaaccccttcccctcccctgttcaggtgtgctctcgccattgctccatctgtgagacgcacccttctatagaagaaaaattgccttgctgagaaaactcatgttcaagtgctatttcttttgtggcactgaaaatttatttctaacaatgggattgccaaaatgatgcttaatcttctttaggttatatttttgtgaataatactaatatatattccaaaattgtatgggatttctaaaattctaatgtctaaatatatgctaccaatcacaattatagttattatgctgttattgtaaattacagaaataaccaaatttccttgtataaagctactaacccaagtaaatcaaataattaaatataaagaaaacagtgttaaaccagctaatactaaaattgtttaaaatagtttataaccaatgcttgatcccatattcctaggaaaacaattaaagtttcaggtacatttggccacctggttggccatttaaacattttataaagggatatcattcaattgtcatttcaatgcatgttttctggttgtataaaagctttcctatgcaacagagctgatgttctaatagtagattattatgctacagtgtattttcaccaggttaaaaaaaaggctttttatggtttggatcttctgagaacatcagaaaaagactgtccttgccatccacactacaacaaaacttagggaccttgagctttgggttcatggtcttgcaactaagaagggttcctccacacttttggaactgtgcacccattgtaacccttgaggtaaagctaaccagggaaatttctcccaagaagaagatggcatccttgatgtgaatatctttcccaaggtcacagattaagacttctagtgacatgaaactcttctctttgaaagtttttttcttgcttatgtctctgtgaacaatagaagtggaaaagtgtctgttatgtgcactaatagggtgtacttttatttgtgaaggagcttccagccagcctgcaagtgtaaggttacatggataagcttatactttggtagataaaggataaaggccaatgtatgtaagaaactttaatggtacatgcattgcctcataatcagtcaaaagcagaacattggttcattcctcttggcccatttcattggttgaagagaacactgccagagggccttcactcttctcaaagggcatcatttgttaagtcctttttccatgatttggagtaaaagaagcaatgattggaaatatatccctcatgataggttctatagcaaattctactgtaaaggctgcagttgcacagtgattctaaattctcttgtgaaagttgggatagaaatggctaaacagaaaaagtatctgtgcagctgctggcacttgtggcctatggggaaatacatcaaatgaggattataaaaattcagtagtggccaggcataggtggctcacgcctgtaatcccagcactttgggaggacgaggcaggcagatcatgacatcaggagattgagaccatcctggctaacacggtgaaaccctgtttctactaaaaatacaaaaaattagctgggtgtggtggcgggcgcctgtaggcccagctacttgggaggctgaggcaggaaaatggcgtgaacccgggaggcgtagctttcagtgagccgagatcgcgccgctgcactccagcctgggtgacagagcgagactccatctcaaaaaaaaaaaaaaaaaaaaaaaattcagtgatcgggaattgatgaagaaattgcttcattaagtgagtaaactctttatctagctcattctttgatctgtttggttttaggaggtttggtttatggagatcttgggtaaggggcatactccaaattcttggtatatcctctaataatagtctccctggtgtgctgcgttctctcaaaggttttaaatgcttgcatgcagccatctctaaaatgaaatatagtttcttttcaactggaataacaagagccaaaagaatctgcaaccatgaggacaccgtaacctatacctgacgtgctgagaatgaaaacccaaaataatagtaaccaagagtggcactaaggccctaagttttggtcccactctcactcaagtgaaaacctgaataaaggggaattttttaaagaaaattatgggaggccattgttttggactgagctcatgcactaggcccctacaaaccaaaccaaaccaaaccaaaatggagtcgctcgtgctaaaactttagggaaacgcatagattctacaagagaccaggttttgttttttttctcctgcatatctctataaaaaacatttctgacagcataggtatcaaccccctgaagttcccattaaatcttttagccaaattcatttcctctcgcctagataatcatcaagcttcagatgatcatgcaaccacggttccagccagttccaggtgaagacaccacccctggccatcaagaagctaccctgcctccacgagatagagcatggcgagagttccgtgatttccaataggtagggactatgccccaggtcggcatgaagcagttacagaagaaagctcttcagtccctctgcctcacataaagatttatggggatcaagtctctcagcggggagatgaggcaggagaatagggcctggaggcaggggacctaaggctgttttacgctgacttcctagaactaaattgaaaggaaaaccctcactttcaacgcctaagtaacaaaaggaccagaggctactccctttgaccttttctgcactacagatggaaaattggctgtggcaacaaattaggctgacttctggcctagtcttcgtttgcatacaagtataactttgttaacttcaccctagcctctgattggttgctttttgcaaccaatcagatatttgcacaggagtgtgacctttgtaacttcagtttagcctctggttgtctcctttctgcaaccaatcagatttatttcgggcgaccactccacttacatgaggtggccaatgggaaacttctagggggtatttgaaccaaagaagattctgtatccaggcccttgagcctctgctgaggccatctcccacagtgtggagtgtactttcgttttcagtaaacccttgctttcattcttttgttacttcattcttgctttgctttgctgggcattttatgcaattatttgttcaaaacgccaagaacctggacaacttgcaatcctgaccctctacgggtcacaaacccaagttgcacccaactggacaaatctccagtaatccatgttcagtggcgcctttatctctggaaggcgttttttcaaacagaaagggcgggagaaaagggctccaagacagggcttgattgaaaatgtggaaccctactgccaccgtgaggaaatcgtttaaagacggaatacgccatcatggcgtccttctcggaaagcctccctgtgggggaaaggctgatctgtaggcccccaggctatgtcttcctgccttttcctctaaggcctgaaaagagacagggacattggcggtatcttggtgtagaatctggagagtgcggggtttggagtgaaccagcagctgccaggaggtactggcacaggaagtcgtggagcggaaacttggttcctccggtgtggggaggacagtagggaaccagtcaaacacacatagaggctcttgtgggcatctgtctcttctacctgccctttggagcaagagtcagcaggctttcacttgctagcatcttgctatgggtcttggggtttctggtagcatcaatatcgctcacaaggaacacagttattccaagggaagtttacaggatttgctgttagaaccttcactctccaggttctacagcaaggtaccgccaatgtccacgtctcttttaaggccttagacgagaaggcagggactctgagcatggagcccaagcctcttccacctccccacagaccagaccttccccaacaggtagtcctcacaagacgacccatgtaatggcgtagggatccgttaaatgacatcctcgcgatggcggtagtgcatcagatatgccagaaagccctgtcttggagcaccgcccccttctcctgcccttcctgtctgaaaaaacgcgactcatagacaaaggcgcaaccaaacatggatgccttctatttgcccagtgtggagcctgctagtcttactgctgcactttttcattttgttttccacttgaaatcaaaccgaggcctaaagcaccggtcctcatcaggaatccagttcttccagaaattaaatatcctcctgacctactctgtgtgggtttgatttacttcagagttacaggtccagtaatttccgaggcatcaaactgtctccttcagggaatacattcagtggatgaactcacaaaaaagagaaaaggagccgggcgcggtggctcacgcctttaatcccagcactttgggaggccgaagctggcggatcacccgaggtcaggagttcgagaccattatggccagcatggcaaaaccctgtctctactaaaaatacaaaaattagccgggcgtggtggcacaggcctgtaatcccagctactccagaggaggaggcaggagaatcacttgaacctgggaggggaaggttgcagtaagcggagagcgcactattgcactccagcctgggcaacagagtgagagtgtctcaaaaaaaaaaaaagagagagagagagaaaagggctaaaagcttgaaagcttggaaaagaactccagcaaaaaatttaaaaatcccagaggtcttcgccctggctcccctgtcaggcatccagggaattcttcctattctaagagccttatgtggtacatcataggcaacaatttggcatgagccattagaggagaaaccaggtgacgctccttactgcatgccatatatactccaaatgccatgatactcatagaacatatgttcaattcatatcaaggtggctcagggtttcatctcatggtctcatcatttaacatcaaaacacagcatgtgcccgtgccattacatattcttcaagtattccctgagactttatggggtgtgtgtttgtgttcgtgtttgtgtgtgtctctgagagttttataattggtcttttaagtataaggattacagtattctccaactagtaaattaaagaataatgcttgacaaagattaagaaaaatccatgtattaacacagaaaaccgctaccatacaacttgtcaaggtaactcatgaacttatggattatttccatgcatctttcaaaatgtgcatacattaacttcatgcaaaaaaataaatctgtgtaaaaagtggattactgtgtacatagtggtttggatcagaccaaatgtgtattttaatgaaactttcagatgcatgaattaattcaaatgtcaccagtactaagtcttatatgtcaacatttcatgccttcaatataaataaaggtaaatcttaacatacagcctcaggaaaattactttagtaaagtagacaatatcagctctttgattttttacagctacatcactacacatttctaaaaaaaagttcatgaagagacaaagacatcagaaattatggctacctaacattttgctcaatttgtgtaaacaatttccactcttaaccatttgcttttggtttccattggatattaacctgagatgtaatccatgcaccctcatcaagcatctcatctttttaagaactcagtttctgcacaaccaaatcttcccatttctactctttttcactctgcatcatatctgcagtattttattgtgatatcaaatagtcttgtagtaatggggagagaccttaggtttccatgcctaaggagagaagaaaaaaaaaagctcacctctaaaggcttggagaagagcaaatctaggcaccaggccacgtggttcttgtcctgattccctactcaggttccccgggaattttactccatgttctaatctagtcagtaggccttatacattgagggggaggatgctatttagtggggcactaacataagggtacggatagctctcaagcctgacaagacacacacagccctacttgaatagacacaaacacaggaatgactgtaaatactaatcagattgatcacaggattttgtctcatagtttcattatttaacactgaattagaaatattttccagtgtcattaaatggctgtcacttaggactgtgccctatgactttcttgtgtatgtgtcttattgtttttcagttgggaatcagtcctatattttctcattagtaacaaagacatggaatttgcaaagaagttaaaaataaccatgtgctgatcaagagaaaagcaatgtcataaaactgtattaaacaatgatcattgtttccatatttcctctcattttttcaacactcagataaaaagttctatatatacagtcaaacaccacaataaatttacattttacttgaatttagatatataaataaagttgaagaattaaaagtttcacatctgattcctgaggtttttttattctcataagaaagttgcaatatctgaattttagacaataaaatatttgcaaaaacttcttgattggactattcatcaaaacataagttctccattttcacttttatatctaaaatatatgtatatttatacacacataaaatagaaacacgtttatatacaatagaaacatatgtattatacatacttatacctagaaaattaggatgtttaattcttctcaaatttttattcttaattctttccttaaaattttatctttgaaacctcaaaagaaagatagcaaaattcaataaatgatagttgaaataggcatctctcacattcagtcacctggaggtgtaacctaagaaaactgtaagatggatgcattcacacaactcacatgcagctagaatgctttattactgtctctgtttatataatgacaaattaaagttttgaatttgttggccaaaaataccatcttcaaacgtatactcattataacacctaccatgattaaatatatatagcattggccgggcccagtggctcactactgtaatcccaacactatgggaggccaaggcaggaggatagcttgagcccaggagttcaagaccattcctggcaatgtagtgagaccccgtatctacaaaaaatacaacaaataaccaggcatggtggcgtgcaacagaagccccagctatgtaggaggcggagatgggacgaccacctgagtccagggaggttgattctgcagtgacccatgatcatgccattgcactctcacctgggcaacaatgagacactgtcatatatatatatatatatatatatatatatatatatatttttttttttttaatattgttatatacctacagacagatataaatacacacacactcaacacagtttaaatataattggatgtatactgtttgaaatttgtacaaaatcttcagcattgtcttatatgccttgaatatatctacatccatatgtacttttgagtgcttggaatttttttatattttactctagaagaactttaagatattacaaagcagaaaacatgctgggtctcatatagtgagaagaaataatgacttttaaaatgtctgtgctaggtattatcatctgttcactctgcacatataatatggacttttataacctaatgttcaaattcccctatagtacaactgtttttgttttttaatgttggatatggggtttccctatgttgaccagtttgatctcgaaatcctggcctcaagcaatcctcccatgtcagcctcccaaagtgctaggattacaggcatgaggcaccaagcccagccacctcgtagtataactgttaaaacaagatttcttcactgataacttgagtacttttcaaatataattattcatggaaataatgacaggtttaaaattattggcactttttaaaactgagttggtaaaattcatataacataaaattaaccattaaaatgtgtgaaattcagtggcatttagtactttcacaatgcagtgcaagcactatctctatctattggcaaagcactttcattaccacaaaagaaaaccctggacccattaagcattccccattccactctctgcccagcccctggcaaacactcatctactttccctcactactgatcatcacaataagtggtcttttccaaagtcttgcttttttcacttagcgcgtttcaaatttcatgcattggttatctatcttattgacatctacctcttggatatggatcttcgctattgtaccttcatccacccaatttatcacctgaaggagacaatttgatgccatggaacttgctggacctgcaactgtgtgaagtaaatcatacccagatagactcagtgaggagtatatttaatttctgaaagaacaaaattcctgataagcacgggtggtttaagctgaattttgtttttagttggaaaaacaaaacaaaaccaaaaaaaaatcaacagttaagaccaggttgcaccaaactggacaaatctccaggcagctatgtttggtggcgcctttatctctggtttgcttatttcatagacgaagggcaagagaaaggcctcaaacatagggcttccctgaaaatgtgcaacactactactaccgtgaggaaatcgcttaaagacataatactccactagagcctccttcccaggaagcctcgctgtggggaaaggctgatctgttgggaggtgggagaggcttggcctccaggcgaggtcttcttgccttctcctctaacgcctgaagagtgacatagacattggtggtatcttggtgtagaacccggagagtgaggggcttggagtgaaccagcagctgccaggcggtcctggcacaggaagtcgtgggtcggggcctcagttcctcctggtgtgggcaggactgcaggaacccactcaaacacacattgaggcttttgtaggcatctgtctcttcttcctgtcccttggagcaagagtcagcaagctttctgatgttggcatcttgctatgggtctttgggtctctgtgaccaaacaacaggtttattcaaagggaagtttacaggatttgttattagaagcttcacactccaggttctatagcaagatattgccaatgtccaggtctcttttaaggccttagacaagtaggcaaggacgcccagcatggaggccaagcctctttcacctcttaccagaccacacctaccccaacaggtagtgctcagagaactctgtaatggcgttaaacgactataattcgttaaacgtcttcctcgtgatggcagtagtgctccagatatgccaagaagtcctgttacgtagccctcttctcccgcccttcctgtctgaaaaaacgccacacatagacaaagagccaccaaacatggatgtcttctattttgcccagtttggagccagctggtcttactgctgtgctttttctttttgttttccacttgaaatcaaaccaaggcctaaaccaaccaccctcatcaggaattttgttctttaagaaattattctactgacctagtctgtgtgggtttcatttacttcagagttacaggtccaataatttccgtggcatcaaactgtctttttcaggggatagcttcagtgtatgaacgcacaaaaaggagaaaagggctgaaagcttggaaaggaactccagcaacaatttaaaaatcccagagatcttggccctggctcccctgtcaggcatccagggaattcttcctattctaagagccttatgtggtacatcgtaggcaacaatttggcatgagccattagaggagaaaccaggtgacgctctttattgcatgccatgtatactccacatggcatgatactcatagtacatatgctcaattcctgtcaaggtgactcagagtttcaactcatggtctcatcatttaacatcaaaacacagcatgtgcccatgccactacatattcttcaagtattccctgagactttatgggctgtgtgtggttgtgtttgtgtgtgtctctgagagttttataatgtcttttaggtataagaattaactagtaaattaaagaataatgcttgacaaagattaagaaaaatccatgtattaataatgaagaaaaccactaccatacaactagtcaaggcaacttaagaacttttggattatttccaggaatatctttaaatatgtacatacattgttaatttcatgaaaaaataaatctgtattgaaagtggattactgtgtacactgtggtttggatcagatcaagtgtgcattttaacaaacctttgaggagggtgaattcatttgaatgtcaccagtacgaagtcttatatgtcaacatttcatgccttcaatatgagtaaaggtaaaccttaaaatagggcctcacgaatattactttagaaaagtagacacttatcatctttttgtttgaatttttaaagatgcattactatacgtttcaaaacaaaacgccatgaagagacaaagacaacagaaactacggatacctaatattttgctcaatatgtgtaaccattttccactcttaaccatttgcttttggcttccattggatattgaactgagatgagatccactcaccctcaacaagcatctcctctttttaagaactcagtttctgcacaaccaaatctccccacttctactctttttcattcagcatcctatcagcagtgttttattatgataacaaatagtcttgttgtattgggaacagaccttaaggatccatgcctaagaaagaattaaaaataaagcttacccccaaggtcttggagaagagcaaatctaggcactgggccacgtggttgttgtccttactccctccccaggttccctgggagttttactccatgttctgacctagtcattaggccttatatgttgagcgggaggccactatttagaggggctataacataagtgcccatgtaactcttaaacctgacaagacacacacagccctgtttgaatggacacaaacgaatgactataaatgctaatcagatggatcacaggattttgtctcatggtttcattattcaacattggaacagaaatattttccaatgtcattaaaaggctatgactggctgggtgtgctggctcacacctgtaatcccagcagtttgggaggccgaggtgggcagatcacttgaggtcaggaggtcgagataaacctggccaacatggtgaaaccctgcctctactaaaatacaaaaaaattagccaggtatggtggtgcatgcccataatcccagctacttgggaagctgaggcaggagaattgcttgaacccaaggcagaggttgcagtgagctaaggtcgtgccgatgcactccaccatgggtaacaaagtgagactccatccgtctcaaaacaaacaaaaaggctatgacttaggactgcctcttatgactttgttgtgtatgtgtcttactgtttttcacctaggaatcagtcctatactttcttattagtaaggaagacatggaatttgcaatgaagttaaaaaaaaccctttgggaggtgggggcaggtggatcacaaggtcaagagattgagaccatcctgccaacatggtgaaaccccatctctactaaaaacacaaaaattagctgagtctggtggtgcgcacctgtagtcccagctactcgggaggcggaggcaggagaatcacttgaacctgggaggcagaggttgcagtgagccgagatcaccccactgcactccagcctggcgacagagtaagactccctctcaaggaaaagaaagggggcggggggaggggggcggtggctcatgcctgtaatctcagcactgtgggagacctaggagggcagatcacctgatgtcgggagttcaagaccagactgaccaacatggtgaaaccccgtctctactaaaaatacaaaattagccaggtgtggtggcacatgcctgtaatctcagctacttgggaggctgaggcaagagaatcacttgaacctgggaggcagaggttgcggtgagccgagatcatgccattgcactccagcctgggcaacaagagcaaaactacgtctcaaaaaaaaaaaaaaaaggaaagaaataaaaataaaaataaccatgtgctgatccagagaaaaccaatgtaataaaactgtattaaacaatattaaccgtttccatatttactccaattttttacacacagatcaaaagttctatatatacagtcaaacacgacaataaatttacattttacttcaatttagctatatataaggttaaagaactaaaagtttcaccactgattccttaggagtttttgatattctcataaaaaatttgcaatatctgaactttagacaataaaatacttgcagagaacttgtgattggcctattcataaaaacataagatctcaacttgcacttttaaatcgaaaatatgtatgtatttacacatacataaacatataaatacatatttatatacaacataaacatatgtattatacatatttatacccctgaaaattaggatttttaatacttctcaaatttttactcctagttcttaccacaaaacattatctttaaaatttcaggctgggcgcagtggctcaagcctgtaatcccaggactttgggaggctgaggtgggcagatcacgaggtcaagagattgagaccaacctggccaacatggtgaaaccccgtctctactaaaaatacaaaaaaattagccaggcatggtggtgcatgcctatagtcccatctactcggggggctgaggcaggagaatcacttgaatccaggaggcagaggttgcagtgagctgagattgagccactgcactctagcctggtgacagagcgagactccatctcacacacacaaaaaagaaatttcaaaagaaggataacaaaattcaataaatggtagttgaaataggcatctctcacattccagtcacctagatgtgtaacctaagaaaactgtaagatggatgcattcacacaactcacatggagctagagtgcttcattagtgtctctgtttatataacgatgaattaaagatatgaatttactggtcaaaaatatcatcttcaaacatatactcactataacacctaccacgattaaaaagatatggcattggccgggcatggtggctcacaactgtaattctagcactttgggaggcctaggcaggtgcatagcttgagcctaggagttcaagtccagccctgacaatgtagagagaccccgtctcttcaaaaaatacaaaaaatagccaggcatggtgacctacaatggaagccctagctacgtaggaggcggaaatgggaggatcacctcagcccagggaggctgatgttgcagtgagccatgatcatgcctctacactccaccctgggcaacagagtaagatgctgtctaaaatatatatatatgcatatctgtgtgtatatatatatatatatatgtgtgtgtgtgtgtgtgtatatacatatgtgtgtgtatatacatatatgtgtatatatatatgtgtgtatatatacatatacatattcagcatcaccttatattctttgaatatatctacatcaatacatacttttgagtgcttgaaattttttatattttactctagaagaactgtaagaaattataaagtagaaaacttgtggtaggtcaaacatagtaagaagaaataatcactttttaaaggtctgtgctaggtactatgatctgttccctatatatacataatatggacttttataaactaatgttcaaattcccctgtagtataacttcttgttgttgtttatttttttttttttgtatttttcattttagatatggggtttcactctgttgaccaggctgatctcgaaccactggtctcaagcgatcctcccatcttggactcccaaagtgctaggattacaggcacgaggcaccttgactggccaccatgtactatagctgttaaaacaagtttgtttcactgataactggagtacttttcaaatataattaataattcatggaaataatgatagctttaaaagtattggcacttttaaaaactgagtttgtaaacttcatataacataaaattaaccattaaaatgtattaatttcaatggcatttaggacactcacaatgcagtgcaagcattaccactatgtagtggcaaatcattttcactaccacaaaagaaaatcctggacccattagttagtcattccccattccactctctgcccagcccctggcaaacactcatctgatttccctcactactgatcatcacaacaagtggccttgttcatcttgttgtgggaaccaggagaccagagagaccaatgggtggaacaggaggattttactaggtggtcaccgactcagcagattaacatccaaaggctgagccccaaaccaagagagggcttgacttttatacatatatctgaaaagggcccaaaacctgtaaggccggtaagcaagcttacagcagaacaaaggcagtttatcaaacagtgacaggttttacagttcaggcatgtcttgtgacctttgccataactgcacagctggaaaacaggaacttacaaaatccttacaagcttgcagaaacagttacaaaaatagttgtgagagcagaacaaagaataatggtatggggaaagaatttcaaaggggaaactgataaaaagaacttgtttttctttcttttttttttttagatgaagtcttgctcttgtcccccaggctggagtgcaatggtgtgatctcggttcactgcaacctcctcctcccgggttcaagtgattctcctgtctcagccttccaagtagctgggattacagctgcctgccaacatgcctggctaatttttgtatttttagtagagacggggtttcaccatgttggccaggctggtcttgaactcctgatctcaggtgatcctcccacctcggcctcccaaagtgctggggttacaggtgtgagccaccgtgcctggccaaataacttgtttttcttatccctgcttctagagcccactccttctcggcccccactctgctgatagtgctatcaaagtcctgacagagccctacttatcgctgggccttggagtgagtcagcccagcacagagaaccagcttttctctcccttttttttttcttttacatctcctgcttcagtactgcttctttcacttagcgcttcaaacttcatgaattggttttctatctctttgatatctgtctcttagatatctatctcttagatatctttctttgtttttgtaccttcatccatccaatgtatcacctgaaggagacaatttgataccatggaacttccaggccttgtaactgtgtgaggtaaatcatacccagatagcttcagtgaggagtatatttaatttctgaaacaacaggattcttgagaagcatgggtggtttaggcctcattttgctttcagatggaaaaaaaaaaaaagtaaaaattcaacagtaagaccaggttgcaccaaactggacaaatctccaggtagccatattgggtggcatctttgtctctgggtggcgttttttcagacgggaagggcgggagtaaagggctccaagatagggattccttaataatgtgaagcacgactgccaccgtgaggaaatcctttgaagacacaatacgccattacagcgtccttcccagaaagacttgctgtggggggaagtctgaactgtgggaggtggcagacgcttgggctccaggctaggtcttctagctttctcctctaagacctgaagagaggccttaacattggtagtagcttggtgtagaaccaggagagtgaggggcttgtagtgaaccagcagctgccaggcgatcctggcacaggaagacgtagggcggggcctcggttcctccaagtgtgggcaggactgaaggcacccattcaaacacacatggaggctcttgtgggcatctgtctcttcttcctgtcccttggagcaagagtcagcaggctttctcgaactagcatcttgctacgggtctttgggtctctggtagcaccagtaccgcgcacaaacaacaggtttattccagggaagtttacaggatttggtattagaaccttcacactccaggttctataccaagacaccgccaaagtcctggtgtcctttaaggccttagacgagaaggctaggactcccagcatggagcaagccttttccacctccccacagagaacttccccaacaagtagtcctcaggagaacaccgtaatggcgtagggatttgttaaacaacatcctcgcgatggcagtagtgcttcaggtatgggacgaagcactgttccagagccctcttttcccgcccctcctgtctgaaaaaacgccacctatagacaaaggccctgcagaatgggtgccttacatttagcccagtttgcagccagctagtcttactgctgagctttttcttttggtttccagttcaaatgaaaccaaggcctaaaccacccgccctcatcaggaatcttgatctgtgttaaaagtggattactgtgtacactgtgatttggatcacaccaagtgtatttttttttttttttttgagacggagtctccgctctgtcgcccaggctggagtgcagtggtgtatctctgctcactgcaagctccgcctcccgggttcacgccattctcctgcctcagcctcccgcctagctgggtctacaggcgcccgccaccacgccctgctaattttttgtactttttagtagagacggcgtttcaccgtgttagccaggaaggtctcgatctcttgacctcgtgatccgcccgccttggtctcccaaagtgctgggattacaggtgtgagccaccgcgcccacccaccccgagtgtgtattttaacaaacatttgaggatcgtgattttattagaatgtcaccagtactaactcttttttttttttttttttttttttttttgagatagagtctcgctctgtcgcccaggctggcgtgcagtggtgggatctccgctcactgcaaggtctgcatcccgggttcaagggattctcctgcctcagcctcctgagcagctgggattacaggcgtgcaccaccacgcccatggagtttcaccatgttggtcaggctggtctcgaaatcccgacctcgtgatccgctggcctcagcctcccaaagtgctgggattacaggtgtgagccaccccacccggcccagtactaagtcttatatctcaacatttcacaccttcaatataaataaaggtaaatcttaacatagggcctcaggaatattactttagtaaagtagacactatcagttttttgtggaatttttacagatacatcactacatgtttctaaaaaaaggccatgaagagacaaagacaccagaaactatggctccccaacattttgctcaatttttgtaaacatattacactcagcaatttgcttttagtttccattggatattaaactgagatgtaatccactcaccctcatcaagcatctcctccttttaataacttagtttctgcacaaccaagtcttcccatttctactcttactcactcagcatcatatctatagtgttttattatgatatcaagtactcttgtagtattctggaaagaccttagctttccatgcctaaggagagaagaaaaaaaaagcttacccctaaggtcttggagaagagcaaatctaggcacaaggccacgtgtttcttgtcctgacttcctccccaggttccctgggagttttactccatattctgacctagtcattaggccttatatgttgagggaggggcggctatttagtggggctctaacataagggctcagatagctctcaattctgacaagacacacacaaccctacttgaatggacacaaatacaggaatgactataagtcctaatcagatgggtcacgggattttgtctcatagtttcattatttaacattggaacagaaatattttccagtgtcattacaaggctatgacttacaactgtgttctatgactttgttgtgtatgtgtcttactgtttttcagttaggaatcagtcctatattttcttattagtaacaaagacatggaatttgcaaagtgaaaagtaaccaactgctgatgaagagaaatgcgacgtcataaaactgtgtattaaacactgataaccgtttccatatttactcatatttttttcttttcttttttttttttttttttgagagggagtctcgctctgttgcctaggttggagtgcattggcgctatcttggcttactgcaagctctacctcccgagttcacgccattctcctgcctcagcctcccaagtacctgggactacaggcgcctgccaacacgccccgctaattttttgtatttttagtagagacggggtttcaccatgttggccaggatggtctcgatctcctgacctcatgatccacccacctcggtctcccaaagtgctgggattacaggcatgagccactgtgcctggcctactcctattttttcaatacacagataaaaaagttctatatatacagtcaaacaccacaataaatttacattttacttgaatttatccatacataatgatgaagattaagatttccacatctgattcttaaggagttcttgatattctcataaaaatttgcaatatctgaattttttacaataaaatatttgcaaagaacttcttgtttggactattcatcaaaacataagttctgaacttgcacttttaaatttaatatatatatttatacatacataaacatataaatccatatttatatacaatataaacatatgtatgttacatacttatacctatgaaaataaggatttttaattcttcttcaaattttattgctaattcttaccttaaaattttatctctaaaatctcaaaaggataaaaaatttaataaatggtaattgaaataggcatctctcactttcagtcagctagatgtgtaacctaagaaaactgtaagatggatgcattcacacagcttacatgcagctagaatgcttcattagtgtctctgtttatataacgatgcattaaaaatgtgaatttgttcaccaaaaatgccatcttcaaacatatactcagtataacatctaccacgattaaaaatttatagcattggctgggcgcggtggcttacaactgtaattgcagcactttgggaggccgaggcaggtagacagcttgagcccacgagttcaataccagccctggcaatgtaggtagaacctgtgtctacaaaaaatacaaactatagctgggcatggtggggtacaacagaagccccaggtacgtataggaggcagaggtggcaagatcacctgatcccagggagattgatgctgcattgatccatgatcatcatgccactgcactccagcctaggcaacagtgagacagtctcatatatatatatggcatttaaaattttgtaatatatctccagacagatataaatacacacacacttgatacagtttaaatataattggatgcataatgtttgaaatttgtacaaaatctgcagcatcactttatgctctttgaatatatctacatcaatatatacttttgagtgctttaatttttttgtattttattctacaagaactttaagaaattataaagcagaaaacatatggtaggtcaaacatagtgagaagaaataatcacttttccctatgcacatataatatggactttttaaaactaatgttcaatttcctctgtagtataacaggttttttactttttattttagatatgggttttcgttgccgggcaggttagctcacgcctgtaatcccagcactttgggaggctgaggcgggcggatcacaaggtaaggagattgagaccatcctggctaaaatggtgaaacccgtctctactaaaaatacaaaaaattagccgggtgtggcggcacacgcctgtagtcccacctacttgggaggctgaggcaggagaattgcttgaacccaggaggcggaggttgcagtgagcccagatcgcgccactgcactccagcctgggcgacaaagcgggattctgtctcaaaaaaaaaaaaaagatatggggtttcgctatgttgaccaggctgacctcgaactcctgacctcaagccatcctcctatctcagactcccaaagtgctaggattataggcatgaggtgtcatgcccggccacccagtagtataactgttataaacaagttttcttcactgataatttgagcacttttctaatataattaattatccatagaaataatgataggtttaaaagtattggcactttttagaactgagtttgtaaaattcatataacataaaattagccattaaaatgtgtgaaattgagtggcatttagtacattcaagatgccgtgcaagcattaccactacatagtggcaaatcattttcattaccacaaaacaaaaccccggacccattaagcagtcattccgcattgggctctctctctgcccagtccctgacaaacactcatctgctttccctcactactgatcataacaagtggccgttttcaacttccttctttcacttagcttgtttcaaatttcatgtattggttatctatctctttgatatctacctttgttgttgtacctgcatccacacaatttatcaccttaaggagacaattttatgccatgaaacttgctggacctgtaactgtgtgaagtaaatcatacccagatagactcagtgaggagtgtatttaatttctgaaagaacaagattcctgatgaacctgggtggtttaggcctcattttgttttcacacggagtaaaaaaaggaaaaattcaacagtaagaccaggttgcaccaaactggacaaatctccaggaagccatgttgggtggtgcctttgtctctgggtggcgtttttttcagccaggaagggcgggagaaaagggcgccaagagagggctttcttgaaaatatggagtactactgccaccgtgaggaaatcgtttaataacgcaatacgccattatagcttctttccgggaagcctggctgtgggggaaggtctgatctgtgcggtggtggaagaggtttgggctccaggctaggtcttcttggcttctcctggaactcctgaagagaaacctgtacattggcgatatcttggtgtagaacctggagagtgaggggcttgcaatgaagcagcagctgcccagcggtcctggcacaggaagtcgtggggcggggtctcggttcctagtgtgggcaggactgcaggaacccactcaaacacaaatggaggctcttgggggcatctgtctcatgtaattgccccttggagcaagagtcagctggctttcatgtgctgtcatcttgctatgggtctttgggtctctggtagcataagtaccgcgcaaaatcaacaaaggtattcaaagggaagtttacaggatttgctattagaaccttcactctccaggttctataccaaaatatcgccaatgtccatgtctcttttaaggccttagacaagaaggcaaggactcccagcctggagcccaagcctcttccacttccccacagaccagtccttccccaacaggtagtcctcagagaacgctgtaataatggcgtagggattcactaaacgacttcctcgcgatggcagtagtgctccagatatgccaagaagccctgtctttgagccaaggtcttccgcccttcctgtctgagaaaacgccacctatagacaaatcacaaccaaacgtggatgccttctattttgcccagttggtagtcagctggtcttactgctgcactttttctttttgttttgcgcttgaaatcaaaccaaggcctaaaccacctgcctccatcaggaatcttgatctttcaaaaatgaaatctcctcctgacctagtctgtgtaggtttgatttacttcagagttacaggaccagtaatttccgtggcatcaaactgtctctttcaggggataaattcggtggatggacatacaaaaagaaaagggcttaaagcttggaaaagatctttccagtaaacaattaaaaaatcccagggggaagggtgcggtggctcacgcctgtaattacggcactttaggaggccaaagcgggcagattgactgaggtcaggagttggagaccagcctggcctacgtggtgaaactccgtttctactaaaaatgcaaaaattagctgggggtggtggcgggcgtctgtaatctcagctactcaagagtctcaggtaggagaattgtttgaacccaggagacagaggttgcagtgagccgagattgtgccactgcgctccagcctgggcgacagagcaagactcggtctcaaaaaaaaaaaaaaaaaaaaaaatcccagggatcttggacctggctccctgatcagacatccagggagttcttcgtattctaagagccttctgtagtgcattgtaggcaacaatttcgcatgagccattagaggagaaaccaggttacgcacattaccacatgccatatatattccaaatgacatgatactcatagtacatatgtttaattcctgtcaaggtggctcagagtttcatctcatggtctcatcatttaacatcaaaacacagcatgtcaccatgccattacatattcttcaaatatttcctgagaatttatggggtgtgtgtgttcgtgtttgtgtttgtgtgtgtctctgaaagttttataatttgtcttttaggtataaggattacagtactctccaactagtaaattgaagcataatgcttgacaaagattaagaaaaatccatgtattaataatgaagaaaactgctaccatacaacttgtcaaggcaactcatgaacttttggattatttccatgcatatctttcaatatgtacatacactgttaatttcatgcaaaaaataaatgtgttaaaagtggattactgtgcacactgtggtgtggataagaccaagtgtgtattttaccgaatctttcagatgtgtgaattcatttgaatgtcaaccgtactaagtttatatgtcaacatgtcacgccttcaatataaataaaggtaaatcttaaaatagggcctcaggaatattgccttagaaaagtagacactatcgccgggcgtagtggctcacgcctgtaatcccagcactttgggaggccgaggcgggtagatcacaaggtcaggagatcaagaccattctggctaacacggtgaaaccctgtctctactaaaaatacaaaaaaaaaaaaaaattagtggggcatggtggcgggcgcctgtagtcccagctacttgggaggctgaggcaggagaatggcgtgaacccgggagggagcttgcagtgagccgagattgtaccactgcactccagcctgggcgacagagcgagacactgcctcaaaaaaaaaaaaaaagaaagaaagaaagaaagaaaagtagacactatcagctttttgtctgaatgtttacagatacatccctacatgtttcaataaaaaggccatgaagagacaaagacaccagaaactatgactacctaacatttcgctcaatttgtgtaaacatattccactcttagccatttgcttttggtttccattggatattaaactgagaggttatccactcaccctcataaagtatctcctctctttaagaactcagtttctgcacaaccaagtcttcccatttctactctttttcactcagcatcgtatctgcagtattttattatgatgtcaaagagtcttcttgtattgggaacagaccttagtgatccatgcctaaggagagaagagaaaaaaagcttacccttaaggtcttggagaagagcaaatctaggcaccaggccatgtggttcttgtcctgactgcctacccaggttccctagcagttctactccatatctgacctaggcagtaggccttacatgttgagggggaggccgatatgtagtggagctctaacataagggtacggatagctctccagcctgacaagacccacacagccctatttgaatggacacaaatacacaaatgactataaatgctaatcagatagataacaggattttgtctcatggtttcattatttaacattggaacagaaatattttccagtgtctttaaaaggctgtgacttacgactgtgtcctgtgactttgttttgtatgtgtcttattgtttttcagttaggaatcagtcctgtattttctcattattaacaaagccatggaacttgcaaagaagataaaaataaccatgtgctgatcaggagaaaatcgatgccataaaattgtgtattaaacactgataaacagttccatattatgggccggacgtggtggctcacacctgtaatcccagcagtttgggaggccgagacgggcagaacacgaggtcaggagtttgagaccagcctggccagcatggtgaaaccccatctctactaaaaatacaaaaaattagccgggcatggtggcgcatgcctgtagtcccagctactcagaaggctgaggcagaattgcttgaacccagcaggcggaggctgtagtgagccgagatcacgccattgcattccagcctgggcgacagagcgagactctgtttcaaaaccaaacaaacgaacagttccatatttactcccattttttcaacacagagaaaaagttctatctatacagttaaacacgacaataaatttacattttagttgaatttagctatacataaggttgaagaaagtttcacatatgattcctgagtttttcatattctcataaaaaatttgcaatatctaaatttaagacaataaaatatttgcagagaacttcttgattggactattcatgaaaacataagtactcggccggtcgcggtggctcacgccaataatcctagcactttgggaggccgaggcgggtggatcacaaggtcaagagttcgagaccagcctggccaatatggtgaaacctgactctactaaaaatacaaaaattagctgggcttggtggcaggcacctgtaatcccagctactcaggaggctgaggcagtagaatcacttgaacacgggaggcggaggttgtagtgagcagagattgtgcctctgtactctagcctctgcgacagagtgagactccatctcaaaacaaacaaacaaaaaataagtactcaatttgtacttttaagtataatatatatatttatacacatataaacatataaatacatatttatatgcaatatgaacatatgtattatacacacttataccgctgaaaactgaaatttttaattctccttgaatttttattcctaattctttccttaaaaattgatctttgaaatctcaaaggaaagataacaaaactcaataaatgatagttgaaataggcatctctcacattcagtcaccttgatgtgtgacctaagaaaactgtaagatggatgcattcacacaactcacatgccactagaatgcttcattagtgtctctgtttatataatgatgaattaaagacacgatttgttggccaaaaataccatcttcaaacatatactcactataacacctatcaggattaaaaatatatagcattggccagacacagtggctcacaactgtaatcccagcactttgggaggccaaggaggtggatagcttgagcccaggagttcaagactagtcctggcaatgtagtgagaccccgtgtctacaaaaaatccaaaaaatagccaggcatggtggcttgcaatggaaaccccagctacttaggtagtggaggtaggaggaccacaggagcccagggaggttgatactgcggtgaaccatgatcatgccattgcactccagcctgggcaacagagtgagacgctgtctaaaaaaaaaaaaaaatatatatatatatatatatatatatatatatatatatatatatggcatttaaaattttgtaatatacctacagatataaatacagacacaacacagtttactctaaatataattggattcatattgtttgaaattttctacaaaatcttcagcatcaccttatactctttgaatgtatctacatcagtatttacttttgagtgtttgaatttttttcatattttactctagaactttaagaaattataaagccgaaaacatatgataggtcaaccacagtgaaaagaaataatcaattttccctatgcacatataatatggactttataaactaatgttcaaattcccctgtagtgcaactggttctttttctttctttctttctttttttaaattttagatatggggtttcgctatgttgaccagaccgatctcgaactcctggcctcaagcgatccacccaactctgcctcccaaagtgctagtattagaggcatgaggcaccaagcctggctgccttgtagtatatctgttaaaacaagttttcttcactgaaaacttgagtacttttcaaatataattaattattcatggaaataatgataggtttaaaagtactggcacttttaaaaactgagtttgtataattcataaaacataaaattaaccattaaaatgtgtgaaatttagtggcatttagtatattcacaatgcagtgcaagcattaccactatctagtggcaaatcattttcattacattcaacttgctggacctgtaactgtgtgaggtaaatcatacccagatagactcagtgagcagtatatttaatttctgaaagaacaagattcttgatgagcatgggtggtttaggcctcattttgtttagagatggaaaaaaaaaaagcgaaaattcaacagtaagaccaggttgcaccaaactggacaaatctccaggcagccatattgggtggcgcctttgtctctgagtggcgttttttcagacgggaagggtgggagaaaagggcgccaagatagggattccttgaaaatgtgaagcacgactgccaccgtgaggaaatcgtttaaagacacaatacgccattacagcgtccttcctggaaagattcgctgtggggaaaagtctgaacagtgggaggtggcagacgcttgggctccaggctaggtcttcttgctttctcctctaaggcctgaagagaggccttaacattggcggtatcttggtgtagaacctggagtgcgatgggctcgaagtcaaccagcagctgccaggaggtcccggcacaggaaatcgtggggccgggccccagttcctcctggtgtgggcaggactgcaggaacccactcaaacacacatggaggctcttgcgggcatctatctcttattcctgtcccttggagcaagagtcagccaacgttctcgtgctggctatgggtctttgggtctctggtagcatcagtaccgcgcacatagaacagggttattccaggggaagtttataggatttgctttcagaacgttcaatctccatgttctataccaagataccgcccatatccaggtctcttttaaggccttagaggagaagacaaggactcctacctagcatggagcccaagcctcttccacctccccacagaccagaccttggccaacaggtagtcctcacggggaagaacactgtaatggtggaagggtttttttttaaacgatatccgcgcgatggcagtattgctccacatacaggaagaagccccggttcaaagtcctcttctcccgcccttcctgcctcaaaaaaaagccacccatagacaagcgttccaaacctggatgctttatatcttgcagtttggagcttgccggtcttactgctgcactttttctttttattttcaacttgaaatcaaactaaaggccgggcgcggtggctcacgcctgtaatcccagcactttgggaggccaaggagggcagatcacctgaggtcgggaattcgagaccagcctgaccaacatggagaaaccccgtctgtattaaaaatacaaaattagccgggtgtggtgacgcatgcctgtaatccctgctactcgggaggctgagataggagaatcgcttgaacccaggaggcagaggttgagggatcgcgccactgcactccagcctgggcaacaagagagaaactccgtctcaaataaaaaaaaaaaaagaagaaagaaagaaaagaaaacaaatcaaaccaaggcctaaaccacctgcccttgttctatcaaaaattacatattctcctgaactagtctgtgttagtttgatttgcttcagagttacaggtccagtaatttccgtggcatcaaaccgtctctttcagcggataaattcggtgggtgaaaacacaaaaaggagaaaagggctgaaagcagaaaagatcttctccggcaaacaatttaaaaatcccagaggtcggccgggcgtggtggctcacgactgtaatcctagcactttgagaggccaaggcgggcggatcacgagttcaagagatcgagactatcctggccaacatggtgaaaccccatctctactaaaaatacaaaaattagccgggcgtggtggtgggctgtagtcccagctactcgggaggctgaggcagtagaatcgcttgaaaccgggaggtggaggttgcagtgagccgagatcgcaccactgtactccagcctggggacacagcgagactccgtctcaaaaaaacaaaacaaaacaaaacaaaaaatcccagaggtctttgacctggctcccctgtgagacatccagggagttctccctattctgagagccttctgagccttctgtggtgcattgtaggcaacaatttggcatgagccactagaggagaaaccaggtgatgctcattactgcatgccatatatactccacatggcatgatattcaaagtacatatgtttaattcctgtcacggttactccgagtttcgtctaatggtctcatcgtttaacatcaaaacacaacatgtgcccatgccattaaatattcttcaagtatttcctgagactttatggactgtgtgtgtttataattatatgtttctctgagagttttataatttgtcttttaggtgtaaggattacagtattctccaaatagtaaattaaagaataatgcttgacaaatattaagaatagtccatgtattaataatgaagaaaaccgctacaatacaacttgtcaaggcaactcatttggattatttccatgcatatctttcaataagtacattgttaatttcagcaaaaaataaatctgtattaaaagtggattactgtgtacactgtgatttggatcagaccaagtgtgtattttaagaaacctttgaggagcgtgaattcatttgaatgtccacagtactaagtcttatttttcaacatttcatgccttcactgtaaataaaggtaaatctttttttttttttttgagacagagttttgctctttcgcccaggctggagtgcagaggcacgatctcggctcactgcaacctctgccttctggtttcaagtgattctcctgcctcagcctcccgagtagctgggattacaggtgtgtgccaccacaccctgctaatttttgtattttcagtagagacggggtttcactatgttggccaggctggtctcaatctcctgacctcgtgatcggcccaccttggcctcccaaagcactgggattgcaggcatgagccactgcacctggcaaataaagataaatcttaaaatttgacctcaagaatattactttagtaaagtagacactatcagctttttgtatgaatgtgtacacatacatgactacacgtttcaaaaagaaggccatgaagaaacaaagacaccagaaactatggctacccaatattttgctcaattcgtgtaaacatattccactcttagccatttgcttttggtttccattggatattaaacagtgatgtaatccactcaccctcatcaagcatctcctcttttcaagaactcagttactgcacaaccaagtcttcccatttctactcttactcagcatcatatctgcagtgttttattatgatgtcaaatagtcctgtagttttgggtacagaccttaggtttccatgcctaaggagagaagaaaaaaaaaagttttacccctaaggtctttcagaagagcaaatctaggcaccaggctatgtggttcttgtcctgactccctacccaggttccctaggagttttactgcacgatctgacctagtcattaggccttatatgttgagagggaggctgatatttagtggggctctaacataagggttcggacagctctccagcctgagaaaacacacacagccctacttgaatggacacaaatacaggaatgactataaattctaatcagatggatcacagaattttgtctcatggtttcattatttaacattggaacagaaattttttccagtgtcattaaatggctatgacttaagactgtcctataactttgttgtacatgtgtcttactctttttcattaggaataagtcctatattttctcattagtgacaagacatagaacttgcaaagtaaaacagtaaccatatgctgatgaagagaaaagcaatgtcataaaactatatattaaacactgataaccatttccatattcactccctttttttcaatacacagataaaaagttctatgtatacagtcaaacacacaataaatttacattttagctgaatttagctatacttaaggttgaagaattaaaagtttcacatctgattgttgaggagtttttgatattctcataaaacatttgtaatatctgaattttggacaataaaatatttgcaaagaacttcttgattggactattcatcaaaacataagttctcaattttcacttttaaatctaaaaaatacagatacatatataaatatatatacatatattaattttttttagatggagtctcactctgtctcccaggctggtctcgaactcctgacctcaggtgatccgcccgccgcagcctcccaaagtgcagggattacaggcatgagtcaccgcacctggctaaaaaatatatatatatttaaacatacataaacatataaatacatatttatatacaatataaacagatgtataatacatacttatacctctgaaaattagaatttttaattcttctagaattcttattcctaattcttaccttaaaactttatctttaaaatcttcaaagaaagataacaaaattcaacaaattgtagttgaaataggcatctcacacatttagtcacctagatgtgtaacctaagaaaactgtacggccaggtgcggttgctcatgcctgtaatcccagcactttaggaggccaaggtgagcggatcacgaggtcaggagttcaagaccagcctgaccaacatggtgaaaccccgtctccactaaaaatacaaaaattaactgggcatggtgacgcatgcctgtaatcccagctacttgggaggctgaggctggggaattgcttgaaccgggacgcaggaggtggaggttgcagtgagccgagatcacgccactgaactccagcctgggctacagagcgagactctgtctcacaaaaacaaaaaacaaaaaacaaaaacaaaaacaaaaagaaaactgtaagatggatgcattcacaccactcacatgcagctagaatgcttcattagtgtctctgtttatataatgatgaattgaagatatgaatttgttggccaaaaatgccatcttcaaacatatactcagtataacatgtaccatgattaaaaatgtatagcattggctgggcatagtggttcacaactgtaatcccagcactttgggaggccaaggcaggtggacagcttgagcccaggagttcaaggtcagctctggcaatgtagtgagacctcgtctatacaaaaaatacaaaaaatagctgagcatggtggtatgcaatggaagccccagctacatagaaggcagaggtgggaggaccacctgagcccagggaggttgatgctgtagtaagccataatcataccactgcactccagcctgggcaacagagtgagacactgtctaaaaaatcatacatatacagcattaaaaattttgtaatatacctagacagatataaatacacacacactcgacacagtttaaatataattggatgcataatgtttgaaattttgtacaaaatcttcagtatcaccttatactcattgaatatatctacatcaatatatacgtttgaatgcttgtaattttttcatattttactctaggagaactttatgaaattataaagtagaaaacatatggtaggtcaaacataatggaagaaataatcacttttgcctatgcacatataatatggacttttataaactaatgttcaaattcccctgtagtataactgttttttatttatatttttaaaaaaaattttagatatggggcttcgctatgttgatcaggttgatcttgatctcctggcctagagtgatgctcccatctcagcctcccaaagtgctaggattagaggcatgaggcaccgtgcccggccaccttgtagtataacagttaaaataagttttcttcactgataacttgagtacttctcaaatagaattaattattcatggaaataatgacagctttaaaagtattggcactttttaaaactgagtttgtaaagttcacataacataaaattaaccattaaaatgtgtgaaattcagtggtatttagtacattcacaatgcagtgcaagtactatctctattggcaaagcattttcattaccacaaaagaaaaccctggacccattaagcagtcattccccattccactctctgcccagcccctgacaaacattcatctactttccctcactactgatcatctcaataagtggtctttttagtcttgtttccttcacttaagctgttttcaaatttcttccattctctctctctgtttttttttgttgttgttgtttagatggagtcttgctctgttgcccaggcttgagtgcagtggtgcaatctcggctcactgcaacctccgcctcctgggttcaagcgattctcctgcctcagcctccccagtagctgggattacaggcgcatgccactatgcccgataatttttgtgttttttagtagagacggggtttcaccatgttggccaggctggtctggaactcctgacctcatgatccatccacctcggcttcccaaagtgctgacattacaggcatgagccatcgcgcccgaccatgatatcttatctcttcgatataaattgggttatctatctttttgtttctaggttttaagagttctttatatgtactgggtattagaagtttctagataattgatatacaaatgtttcctcacattgtgtcaattggcttttcaagttcttgatagtgtatattgatgcaaaaagtttttaatttcaggaaagtccaatttatattttcttttgttaattggtgcttttggtggtatagctaaaaaatcattgccaaatctaaagtcgtgacgatttatccctatagtgtccctgaaggtttcatagctttagctcttacatttagaaatttgatacattttgacttatttttggatataatgtgaggcagaggactaaattcatccttttttttttttttttttttgagacggagtctcactctgtcacccaggatccttaaattttttctttcttttctttttttgagacggagtctctctctgtcacccaggctgtagtgcagtggcacaatctccgctgactgcaagctccgcctcccgggttcacgccattctcctgcctcagcttcctgagtagctgggactacaggcgcccgccaccacgcccggctattttttttttttgtattgtttagtagagacagggtttcgccgcgttagtcaggatggtctggatctcctgaccttgtgatccgcccacctcagcctcccaaagtgctggattactggcgtgagccacagcgcccggcctaaattcatccttttgcatatgcataaccagttgtctatgtactatttgttaaagactctattaattactcataaaatgacctgaataactttgtcaaaaatgaattgaccacaacgtctgggtttatttccagactctccatctcttccattaatcactgtgtgtattcttatttaattatcacactgctttgattactctagcttttctagtaagttttgaaatatagaagtgtgagtcttctaccttggtttttcttattcaaactttacattggttatcagatctctggcaatttaataggatctttagaatttgtgctccttttttacaaaaacaaacaatgctcattgggataataatgattgcattaaatttatagatctcagtgggtagtattggtatgttaaaaatattttgtcttccaacccactaccacaggatgtccttttttaaaatcaaggttatctttaacttcttctccaatattttgtgattttcaatgtataagactttcatctattaactattgtcctaaaaatatgattcattttgatgctattgtaaagggaattgctttcttaatttaattttcagattattcattgctagtgtacacaaataaaactacaactgatttttccgagttaatgttctatcctgctgtgcttgctagatactgttcactagctctaatattgttgttttctggatttttaagcattttttacaagatcatcgtatttgtgaagagaaataatttccattttttcttttcaattgggatgtattttatatatcttcattgcctgacgccctgggctaaaattttaagtataatgttcaatacaagtggcaaaagtaggtgttcttctcctgttcctgattttagaagcaaagctttcagtcgttccctcttgactatattattagctgtaggtttttaattaatgccccatatatcgtgctgagaaaatgatcttctaattatacattattaactgttttgagttgcttttctggagagatggactacagaaagtgtctactgcaccattgtcattgatgtcacttttgccatctgtttttgaatttactgaaacactcatgcttcttcaaaatgtgcctgacacaatagtcatacatgaaaaagtaaagttgttacagttagttacataggcaataagcagggcaggaaaggactctcccccacccaatagaaatgtcacatgatggttcagcaatgatcacattgtctccctaaaaatgataatttggtagcaagggagaggcaatctcctgatggcccacacctgataatattaaaagtgtgaactgaatgcaggccccagggagaagcagcttcttgggcatgcgtattaagacacaaaatggcgaaatatgatgttccgggtacatgccaccagaaaaaggaaaaaagcctcagatgggcatgtgtataactccctaaacacactgcacagtgctcaattccaaagggtaaggagggcactgcgcatgcggaaagctcaccctaaaggaagaatcatgagcaagaggtaagcctataaggtcccatgatcaaggttaaaaggtctttttgttctcttggccactcaggcacccacttggatctcttccaagggttctttctttcctttctttcctgttctaaagcctgttaaataaacttccactcctgctctgaatcttgcctcagtctctttttctgctttatgaccctcagtcgagttatttctttggaggaggcaaggactgaagttgctgtcgacctatatagatatgccgcctgttactcggggtaactcggttcactgccaccgctaacaaagtgagatcatgggtaatgctacctcccacagacaagcacttttaaaatgtggattaattttcaatccttttcactccttttgtttcccatccctttatgtgtaacaactccactaagaaagtaaataaacaaaaaataaaaaggaacggccgggcacagttgcttaagcctgtaatccagcacactggggggccgagacgggctgatcacatgaagtcaggagttcgagaccaccctgacccacatggtgaaaccccgtctctactaaaaatacaaaaattagccaaacgtggtggagcccatctgtagtctcagctgttcggggggctgagacaagagaatcccatcaacctgggagacggaggatgcagtgagctgagatcgtgctgctgcactccaggctgggcgacagagcaagactccatctaaaaaaacaaaaccaaaaaacaactctactagaaaatgtaaaactttaggtcctttcagtctttagacaactagatgcccttgagactatcagcaaacatactggctcctgctttatcacacctggaacaggcctgtctttggtgttctcatactgctgcaacaaaggactgtgatacagtaacactgcctgaaagcttactaactcttgctccaagggacagaacagaacacacacacccatcccccccacacacagcatctaatgtctcaggaaatccctgaagaatatgtaatgcatgggaacatgctgtgttctggtgttaaatgttgagaccatgagatgaaactgagtgatctcgatagggactgaacatagggactatgaggatcacgccatgtggagcatataggccaaggagtaatgaccagatggtccttactctatgacttaaaccaaatttttgcctacaatgcaacacatgaggctagaacatgaactctctggttgtccgagaggggaaccaggtcaaagaccaccaggatttgtaaactgtttgccaaagatcttccccaagtttcaaataaatttttcctaattgtaccttcatccacccagtttatcacctgaaggagacaatttgatgccatggaacttgctggacctgtaacagtgtgaagtaaatcatacccagatagtctcagtgaggagtatatttaatttctgaaagaacaagattcgtgaggagcatgggtggtttaggcctcattttgttttcagatggaaagaaaatagcaaaaattcaacagtaagacaaggtcgtaccaaactggacaaatctcctggtggccatgatccgtggggcctttgtctctgggtagcattttttcagacagaaaaggcgggagaagaaagctcctagacagagcttccaagaaaatatgaagcactactgccaccgtgaggaaatagtttgaagacagaatccgccattacagtattcttccctggaagcctcgctgtgggggaaggtctaatctatgctgaggtggaagaggattgggctccaggctaggtcttgttgccttctcctctaaggtcttaagagaggcctggacattggcggtatcttggtgtagaacctggagagtgaggggcttggagtgaagcagcagctgccaggcagtcctggcacaggaatttccggggcagggcctctatttccccagttgtttgctggacaacaggaacccactcaaacacacatgcaggctcttgtgggcatctgtctcctgttcctgccccttggagcaagagttggcaggctttcatgtgcttgcatcttgctacaggtctttgggtctctggtagcatcagtaccgtgtacaaggaacaggattttaccaagcgacattcacagtatttactttccttcactctccaggttctataccaagacactaccaatgtccaggtctttttttttttttgacggagtctcactgtgttgcctaggctggagtgcaatggcgagatctcggctcactgcaacctccccctcccgggttcaagcgattctcagcttcctgagtagctgggattacaggcgcctgccaccacatccgactaatttttgtatttttagtagagatggggttttaccatgctggccaggctggtcctaaactcccgacctcagacgatccgcccgcctcagcctcccaaagtgtggtctttgaggatagggcaaggatgagcagcatggagctcaagcctcttccccctccccacaggccagaccttctccaacaggtggaaggactgtcttcaggggaaggacattgacatggcttaggcatagggcgtagggcgttgcttaactatgtcctaacggtggcagtagtgctctagatgtgctaacaggtgtcgtggagccttcttctcccgcccttcttgtctgaaaaaacgccacccaaagacaaaggcacaaggaaacatggctgccttgctttttgcccagtttggagtcatctggtcttactgtggcaattttgcttttgttttccatctgaaatcaaaccaaggccgaaaccacccaccctcatcagaaatcttatttgttcagacatttaaaatcctcctaacctagtctatatgattacgatttacctcagatttataggtccagtactttccatggcatcaaactgtctccctcgggggataaatttggggatgaaagcacagcgataaaattgcttgaggctccgagaccaccaggatttacaaatcctggtggtctctattctggctccccttccagacaaccagggagttcttcatgttttagctcatgtgttgcattgcagacaacaatttggcatgaaccatagaggagggaccagatagctgtcattactgcatgccatatgcgctccacatggcatgatactcatactacatatcttcagttcctatcaaggttattcacagtttcatctcatggtctcgtcatttaacatcaaaactcggcatgttcccatgacactacatagtcttcaagtatttcctgagactttatggggtgtgtctgtttgtgtgtgtgtgtgtgtgcatgtgtattttataatttgtcttttagatataagtcttacagtattctcccactagttaattaaagaataatgcttgacaaagattgagaaaaatcaatgtactaataaagatggaaagcactacaatacaatttgtctaggcaataaataaataaatttggattatttccatgcactcccaggcttattaggaagaggaaattcccgcctaataaaagaatatatttccatgcatatattcccgcctaataaattttggtcagactggttgatctcaaaaaccctgtctcctgataagatgttatcaatgacaatggtgcctgaaacttcattagcaattttaatttcccctcggtcctgtgatctctccctgcctccacttgccttgtgatattctactaccttgtaaagtacttgatgtctgtgacccacacctattcgcacactccctccccttttgaaaatccctaataaaaacttgctggtttttgcagcctgtggggcatctcagaacctaccgacatgtgatgtcttccccagaagcccagctttaaaatttctctcttttgtactctgtccctttatttctcaagctggccgacgcttaaggaaaatagaaaagaacctacgtgaatatcggggctggttccccgatatatacacatcattttttttcttttttgagactaaaactctctctgtctcccagcaggagtgaaatggcgagatctcggctcattgcaacctccagttcaagcgattctcctgcctcagcctcctgaatagctgggattacaagtgcatgccactaggcctggttacttggttttttttgtttgttggttttgtttttttttttttttgagacggagtctcgctctgtcacccaagctggagtgcagtgatgtgatctctgctcagtgcaacctccgtctcccaggttcaagtgattctcctccctcagccttctgagtagctgggactaaaagcatatgccacctgcccggctaatttttgtgtttttagtagagacagagtttcaccatgttagccagaatggtctccatctcccaacctcgtgatctgcccgcctaggcctcccaaagtgctgggattacaggcgtgagccacctggaccatccccaattgttttgtatttttagtagacacaggatttcaccatgttggccaggctgttctccaactcctcaccgcaagtgatccaatcaccctggcctcccaaagtgctgggattacaggtgtgagccaccacgcccggctatatatacattcctaatttcatgcaaataacaaatctgtattgaaattgggtcacactctacactgtggtttggagcagatcaagtgtgtattttaacaaagctttcaggaggatgaattcatttgaatatcataaatggtaaatgttttcaacattgcaagccttcagtgtaaatgaaggtaactctgaaaaatatatgctcagaaacattcctttagaaatgtagacaccattcattttttgtttaaatttttacagatgcatcacaacgtgcgtattggctctctagaatacatacatgactatatgtttggtttaaggttatgacatgttagaagtagagtaaaatgcactgggcgcggtggctcatgcctgtaatcccagcactttgagaggccgaggcgggcggatcatgaggtcaggagatcgagaccttcctggctaacacggtgaaacctcgtctctactaaaaatacaaaaaattagccagacgtggtggctggcgtctgtagtcccagctactcaggaggctgaggcaggagaatggtgtgaacccaggaagcagggcttgcagtgagccgagattgcgccactgcactccagcctgggtgaaagagcgagactccacctcaaaaaaaaaaaaaaaaaaaagagtagagtaaaatacactttactttgttatttattatttatcttatggtgtggtaggtttaatccacaaggttcaacaatttgctattctccctaaatcagaggcaaggaatggctgtttacgaggatacagagaatgcaattaagattttatgatggctaaagggactacctggtgcaaatgaatgacatgtatccaacctaaatgggaatgataggctcattgcccctccacactatcttccattgcagaataaaccaatcaacctccttgtcactaccactggtacttggctaggtgtgatttccttgccaggcttctatccactgcccaggcacacagcctctattaaagatagttagcaaggggtgaataaaagatcacttagcctaaagaattctaggtttggggacaccagcatttctaccttcagatatgagacactgtcccataggtaggtctgtattcttccatgaaaatggtcaggtcaaactattcctccataggaggtagtttagcagatgtctaagtctactttaggtgaaatactctggggaggtaagatatcaagggtcatggagaaatgcttcccagagagtctccaagacacttgtgcatgccaatagcatttatgtatgcagatcatcattcaactagacaaagtcaaagatgtcaaaaaagctaggttaccctagaatgccttaccctggaatgcctgcctgaatcctcagaggccaggagaggtcatacctgaacaagctcttgaagcactgtaatgtcacagtgcagaaccagactaacattaattcctttcattaagaattcagatactaaaataataaattctgaggaagaatgtcatgaggatcaagtcacccatacacttttagtcaccattttgattctcaattatgagtcataaagtatctagaggtctccacaccaaaggttggatatcttcattaggaaatagatttgaagctgctacagaaaatactagctaggatgcagtagataatgatttgctcaggcctaaacaatgccatacttaccaaggacatcgaacagaaaagagccacctatctgccctccttgagagaactgagatgacatcggcgtcctattatgacaaaagactttctcctgaacctataacgtcacagaagctgctggcttgtgcgctcagataattgcttaggccttccattgcatttttggccttcatcctctttagcatatcagctctcctaaaagatgatctggcccacataggcatctcagtgtatccttactgctctacagaggtccttctagctataggcaatggtggttagaattttagtgtattgaggaccatgtgagtgacgctgacttcagatagatggttcctggaattggcctgtcattgccagccaacactgctgctataaatgtcacagccccacaacacaaggacaaccaggttgcctaaagctcccaagggcatattcataacataaatgccccaagggtctgtacttggctgtatcattttctagccttgtccccactatgagaaaacaggccctgtcctctacttcctgtgccaaaacttcctggaagcagctggctcagtcctgctccctcactcagcagatacttcacggagactttgcatttgttcattgcttctgccaggcctcagagaaaaggataggaagatcaacttgtgtctcgggtctgttcagccttcactggcttttccttcaattgctagggctcacatggaggaaacgctcacggctttggatgctacgaaactgtttccgcacgatggcagtattgtacgggagaagccaactgactttgctctaggcgctattctcccgcccatcacatttcaaaaaaaggccaagaagagacaaagacaccagaaactagaactacttagcagtttgctcaatttgtgtaaacttattccactcttagcattttgcttttgttttccattggatattaaaccgaggtgtgatccactcaccctcatcaatcatctcctcttttcatgaactcagtatctgcacaaccaatcttctcatttatactcttcttcactcagtattatatctgctgtgttttcttacatcaaattgtcttatagtactggggcagacctcagggatccatgcctaaggaaacaacaaacaaacaaagaaatgttaacacctaaggtcttggagaagagcaaatctaggcaccaggccatgtggttcatttgtttttttttttgagacagagtcttgctctgttgcccaggctggagtgcagtggcgctatctcggctcactgtaagctccgcctcccgggttcacgccattctcctgcctcagcctcctgagtagcagggactacaggcgcccgccaccacgaccggctaattttttttttttttttttttttttttttttttttttttttagtagagacggggtttcaccgcattagccaggatggtctggatctcctgacctcctgatccgactgcctcggcctcccaaagtgctaggattacaggcgtgaaccaccgagcccggccaggccatgtggttcttgtcctgactccctacccaggttccctaggagttccatttcatgttctgatccaggcattgggccttatatgttgagtgggaggctgccatttagtggagctctaagataagggaccaggtagttctcaagcttgacagagacacagaacccgattcgaatggacacaaacacaggaatgactataaattttaatcagatggatcacaggattttgtctcatggtttcattatttaacgttggaacacaaacattttcctgtgtcattaaatggccatggcttaagactgccctataactttgctgtgtatatgtgttactgttttccagttaggattcagtcctatattttctcattagtaacaaaaaggtggaatttgcaaagaagtaaaaaaaaaaaacccatgtgctgatcaagagaaaagcagtctcataaaactgtatattaaacactgatacccttttccatatttattccatttttcaatacatagataaaaagttctatatatagtcaacacaatgaatttacatttaaattggatttagctatgcactgcattttagtatgaatattccatagtatgaatgaagattttcattctaaaatttgatttctgaccagtttttgacattgtcatataaaatttgcaatttctgaattttggacaataaaatatttgcaaagaactatgtgattggactagtcattaagaattaagatctcaccttgcttttttaatctataaaatctatttatacatacataaacacatatataaatatatatattttacatagttatgcctctgaaaattaggattttaaaattattcttgaatttttatctctaattcttaccttcaaattttatctttaaaatctcaaaagaaagaaaacaaaattcaataaatgataattgaaataggcacatctcatattcagtcacttagatgtgaaccccagtaaaactttaagatggatgtattcacaccactcacatgaagctataatgtttcattaatgtctctgtttatgtaactatgaattaaagatatgaatttattggtcaaaaatatcatattcaaatgcatgctcagtataacactgaccatgatataaaatatatggcattggccaggcgtggtggctcacaactctaatcctggcactcttggaggctgaggcaggaggatcacttgagcctgagagttcaagaccaatttagtaattagcaattttggcaatgtagcgagtccctgtctctaaaaaaaaaaaaaaaaaaaaaaaatagccaggcatggtgtcatgcacctgtagtcccagctactcaggaagtggaggtgaaaggatcacctgagtccagggaggttgaggctgcactgagccatgatcctgccactgcactccagtctgggcaacagagtctgatcctgtgtaaaaaaaacatatatatggtatttaaacatttgtatatgcatatgaacagatatgaatacacacagagtaccgcacacattttactttcaatataactggattcatactatttgaaatttggtccaaaatcctcagcatcaccttataatctttgaatatatccatatcaatatatacttctgagtgcttgagtttttttatattttactctagaagaattttaagaattataagcagaaaacatatggtaggtcaaacacagtgagaagaaataatcacttttaaaatgtttgggctacgtattatgatttgttcctttgcacatataatatgtacatttataaactaatgttcaaattcccctgtagtataattgttaaaacaagttgttaaaaccctggacccatgaagcagtcattccccatgccactctatgccgagcccctggcaaacactcatctgctttccctcactactgatcatgacaataaggggcctttttcattttgcttttttcacttagcatgttttcagatttcatccatgttgtaactgataacttgagtacttttcaaatataattagttattcctggaaataatgataggtttaaaaatattggcactttttaaaactgtgttggtataattcatgtaacatataattaaccattaaaatgtgtgaaattcagcggcatttagtacattcacaatgcagtgcaagcactaactctgtgtagtggcaaataattttcattaccacaaaagaaaaccctggacccatgaagcagtcattccccatgccactctatgccgagcccctggcaaacactcatctgctttccctcactactgatcatcacaataaggggcctttttcattttgcttttttcacttagcatgttttcagatttcatccatgttgtaatatatgtcagtacttcatttctttttgtagctgaataatatccatatgtatatatcacattttgtttatccattcatcaagtgattgatgtttgcttgtgttcaccttttgggtattgttaataaatatatacagtgagtatatacatgtacttttttgagtatttgttttcaattgtttgcggagtatacttaggagtagagctgctaggtcatacggttatttctatgtttaaatttttgaaggactgataaacttttccatagcagatgcgcaatttagcatacccaccttcactgcagaagggttccaatttctccgcctccccacccatatttgttctttttaagtaatatccattctagtgggtgttaagtggtatcatgaagtggttctgatttacatttctgaaaacactaataatggaagtatgttttcatgtaattgttggtcatttgtgtatcttctttggagaattgtctatttaagacctttgcctattcttaaaattgatgcattatagttgtacatatttatggggtacacatggtattttgatgtatgcataaaatgtgtgataaccaaaaaaggaaaactgggatactcattccctactgcatttattatttgtgttcgggaacatttcaaatgtgttttatctatttggaaataaccattaaattattgtcaactatagatgtcctaactgtgctgttgaacactagaacttactccttctgtctaactgtatttttgtagccattaacaaacctgtcttcattcccctctcttcctaacttctggtacccaccattctactctatacataccatgagatggattcctttagctcctacatatgagtgaggacatgtgataatttgtctttctgtatctggcttatttcacttaacatagtgtcctaaagttccattcatgttgctgcagatgacagaattccattcttttttctggctaaataatcttccattttatatgtatgccacagtttcttaatccattcatccattaatgaacagttaggttgattccatatcttgactactgtgaataatgctgcaataaacatgagaatgcatatatatatatatatagtactgatttcccagcagtgggattgctacatcatatggtaattctatttttagtatttttgggaaactccatcctgtgtctcatagaggctgtattaatgtacattgcaggcaacattatacaagcattcctctttctctgcttactagccaacacctgttactctctgtcttttttgtaagagtcatttgagctggggaaatacggtaccccactgtagttttgatttacatttccctgatgattagtgatgttgagcattttttcatgtatccgttagccatttgtgtgcctttctttcagaaatgtctattcagatcatttgcccatttgtaaatcagatatatttgttttttttctattgagctgagcttttttaagtttgcaaatatattctctcttactgtaggttgtctcctcactttattgttttctttgctgggcagaagcgttctagcttgatttactctcatttgtccatttttgctttgattgccagtgctttttgaggtctcccacaaaaaaatcattgcccaaaatgatgtcttaaagcatttccgcagtctcttcttctggtactttcatattttcgggtcttttcttatatttgttgagccttgttctgtggcctaacacatgctctatactggagcgtgttccatgtgctgactgatgacaagaatgtatattctacagcaattggatgaaacattttgtaaatgtcagttaagttcatttggtctagagtacagtttaattccaatgtttctttgtctggataagctgtccattactgaaagtggggtactgaagtctcccactattgttgtacacctgtctatctctccgtttagatctccaaatgtttgccttatctatttgtgtgttccagtgttgggtacgtacatattttaaattgttatatcctcttactgaattggcatcttcattttttgttttgttttgttttttttgtttgtttgttttttgagtctggctctgtcgcccaggctggagtgcagtggcgcgatctccgctcactgcaagctccccctcccaggttatgccattctcctgcctcagcctctggagcagctgggactacgggcgcctgccaccacgcccggctaatttttgtatttttagtagagacgggatttcaccgtgttggccaggaaggtctcgatctgctagcctcatgatccgtccgcctcggcctcccaaagtgttgggattacaggcgtgagccaccgcgcccggccggcatctttattgttatacagtgaccttctttgtctctctctacagtttttgactttaatctaatttatataagtctagcctttcctgttctttttccattcctgttcattttcatgttgttgctgatgtcccgctctggtttgagatcttctttgcctgagtaaaagagaagtccccagatttaatgcactggggttgctagcttcaactccactttcagtctcagactaccccctcagggatttttcctcctacaggcagtcaggatgcctcctagggattgaggcaagaataggatccctgcaaaggacaccaaaatgggagagaagctagctctctgccttgatctcacattttacagaggaaactgtgaaccaaggggtacttttctttttttcttttcttccttttttttggtgggggggggagcagggggatggaatctcactctgtcacccaggctggagtgcagtggcgcaatctgggctcactgcaacatctgcctcccaggttcaagtaattctcctgtctcagcttcccgagttgctgggattataggggcacaccaccacgcccggctaatttttgtatttttagtagagacggggtttcaccatattggtcagtctggtctcaaactcctgacctcaggtgatccacctgcctcggcctaccaaagtgctgggattataggcgtgagccaccgcgcccagtcaagggggacttttctacatggtgcctagcagccttgggttggggagtcatggagagagaagtccattagtctttctagctgctcatactttttcacttccttatagccccatggatagtcacagtctcaatgttcagttctggaatattgcttctagtaatcttgtctctacacagctgtttttacttttctttgaggtaaagtcagatcacttctgctataccatgttggtgatatcactctccctttgcctattttttaaaaattgggttatttgtctgtttattgttgagttttaagagttatttgtttttattggatattagaagtttttagataattgatttggaaatatttcctcccattctgtaagttggcttttcaagttctgaattgtgtactttgatgcaaaaagtttttaatttcagggaagtccaatttattttttcttttgtcattgctgcttttggtggtatagctaataaatcattgccaaatctaaagttgtgaagatgtatccctatagtttccctgaaggttttatagctttagctcttatatttagaaatttgatatattttgagttaatttttgcatataatgtgaggtagaggtctaaattcatccttttgcatgtagataaccagttgtctaagtactatttgttaaagactctattaactactcataaaatgaccttaataactttgtcacaaatgaattgaccacagtgtctgagtttatttccaggctctccatcttttccattaatcactgtgtgtattcttatttgattatcacactgctttgattactccagctttcctaataagttttgaaatccagaagtgtgagtcttccaccttggtttttcttattcagagtttacattggttattcagatctcttgcaattcaataggatctttaggatttgtgttccttttttacaaaaaaaatgctcattggataacaataaggattacattaaatctatagatctctatgggtagtattgccacgttaaaaatatttagtcttcagacccattaccacaggatgttctttattaaaatttaggttatctttaacttctccattattttgtgattttcagtgtacaagactttcatctatttagttaattattgtcctgaaattatgattcattttgatgctattgtaaatggaattgctttcttaattgaattttcagattattcattgctagtgtacacaactactactgatttttccaagttaatgttctgtcctgcagttgcttgctggatcttgttcactacctctaatactgtttttctgggtttttgagcttttttttttttttttgactggagtcttgctctgtcgcccagactggagtacaatggcacgattccggctcactgcaacctctgcctcctgggttcaaacgattctcccacctcagcctcccgagtagctggaattacaggcacccgccatcatgcccgggtaatttttgtatttttgtagagacggggtttcaccatgttggccaggctggtcttgaactcctgatcttaggtgattcacatgcctcagcctcccgaagtgctgggattacaggtgcgagtcactgcgcctggcagcattttttataagatcactgtatttgtgaagagaaataatttccattttttcttttcaactgggatattttttatatatcttcattgcctgatgaccccagctagattttaagtataatgtttaagagaagcggcaaaagtgggcatttttctcctgttcatgattttaggagcaaagttttcagtctacctcttgactatattattagctgtaggttttaataaatgccccatatatcgtgctgagaaaatgatcttctaattacatattatagattgttttgagttgcttttctggagagatggactacagaaagtgtctactgcaccattgtcattgatgtcacttttgctacctgtttttgaatttgtaggaacactcatccttcttcaaaatgtgcctgacaaaatagtcacatatgaaaaagtagttacagatagataggcaatgagcacggcaggaaagggctctccctgacccagtaggaatgtcacatgatggttcggcaatgatcacattgcccctctaaaaatgataatttggtagcctgggagagacaatctcctgatgatccacatctgttaatattaaaagtacgaattgaatgcaggccacagggagaagcagcttcttgggcatgcgtattaagacacaaaatggcgaaatatgatgttccgggtacatgccaccagaaaaaagaaaaaagcctcagatgggcatgtgtataactccctaaacacactgcacagtgctcaattccaaagggtaaggagggcactgcgcatgcggaaagctcaccctaaaggaagaatcatgagcaagaggtaagcctataaggtcccatgatcaaggttaaaaggtctttttgttctcttggccattcaggcacccacttggatctcttccaagggttctttctttcctttctttcctgttctaaagcctgttaaataaacttccactcctgctctgaatcttgcctcagtctcttttcctgctttatgctcctcagtgaagttctttcttctgaggcgccaggactgaagttcctctggacctatatggatatgccgcctgttactcggggtaactcggttcactgccaccgctaacaaagtgagatcatgggtaatgctacctcccacagacaagcacttttaaaatgtggattaattttcaatccttttcactccttttgtttcccatccctttatgtgtaacaactccactaaataaataaataaataaatagaatggccgggcacagtggcttacgcctgtaatccagcacattgggaggccaaaacgggatgatcacctgaggtcaggagttcaagaccagcttggcccacatggtgaaaccccgtctctactaaaaatacaaaaattagccgaacttggtggaacccacctttagtcccagttgttcgggaggctgagacaagagaatcccttcaacctgggagacggaggatgcagtgagctgagatcgtgctgctgcactccaggctgggcgacagagcaagactccatctaaaaaaacaaaaccaaaaaacaactctactagaagatgtaaaactttaggtcctttcagtctttagacaactagatgcccttgagactatcagcaaacatactggctcctgctttatcacacctggaacaggcctgtctttggtgttctcatactgctgcaacaaaggactgtgatacagtaacactgcctgaaagcctgctaactcttgctccaagggacaggacagaacacacacacccatcccccccacacacagcatctaatgtctcaggaaatccctgaagagtatgtaatgcatgggaacatgctgtgttctggtgttaaatgttgagaccatgagatgaaactgagtgatctcgataggaactgaacatagggactatgaggatcacgccatgtggagcatataggccagggagttatgactgctatctggtccttactctgtggctcatgccaaattgttgactacaaacaacacttgaggctagaacatgaagaactcctagttttctgggagggaaaccaggtcaaagaccatcaggatttgtaaattgtttgccaaagatctcttcctagtttcaaataattttttccttattgcacttttatccaccaagtttatcacctgaaggagacaatttgatgccatggaacttgctggactgtaactgtgtgaagtaaatcctatccagatggaacttgctggactgtaactgtgtgaagtaaatcctatccagatagacacagtgaggagtatatttaatttctgaaagaacaagattcctgaggagcatgggtagttcaggcctcattttgttttcagatggacagaaaaatagcaaaaattcaacagtaagacaaggttgcaccaaacaggacaaatctccatgcagccagatttggtggcgcctttttcctctgagtggcgttttttcagacataaaaggcgggggaagagtgcgccaagatagggcttccatgaaaaatgtgaatcactactgccaccgtgaggaaattgtttaaagacagaatccgccatcacacactccttcccaggaagctatgggggaaggtctcaattgggccgaggtggaagaggattgggctccagactaggtcttgttgccttctcctctcaggtcttaagagagctctggacattgacggtatcttggtgtagaaactggacagtaaggggcttggagtgaggcagcggctgccaggcggccccggcacaggaagtcgggagcggggcctcggttcctcctggtttgggcaggacagcaggaacccactcaaagtcgaattcttgctcttgtgggaatctgtctcctgttcctgccccttagagcaagagctggcgggctttcccatggtgtcatcttgctacaggtctttgggtctcttgcggcatcagtatccgcccacaattgacagggttcctccaagggaaatttacaggatttgctttccttcactatccaggttctataccaagacaccgccaaagtccaaatctcttttaaggcgttagacgagaaggcaaggaggatcagcatggatcccaggccttttctacctccccacagaccagaccttctccaacaggtagccctcaggggaaggacgttgacgtggcgtagggtgtctttaaactatcaccttacgatgggactagtgctctagatgtgccaagatgtgtcttggattccctcttctcccgccctccctgtctgaaaaaacgccacccagacacaaaggcacaagaaaatatggctgccttgttttttgcccagtttggagtcatctggtcttactgtgtcacttttgtttcccatctgaaatcaaaccaaggcctaaaccacccaccctcatcgggaatcttactccttcagaaacttaaaatcttcctaacctagtctatatgattatgaattacctcagacttacaggtccagtagtctccatggcatcaaactgcctcctcaggggataaatttggggatgagggcacaaggataaaactgcttgaacctcagaggagatcttttccagcaaacaagttacagaccttggtggtctctgacctggctccccttcccgacaaccaggaagttcttcatgttctaccgcatgtgttgcattgtaggcaacaatttggcaagaaccatagaggaggaaccagaaagctgtcattgctacatgccatatgtgctccacatggcatgatactcatactacatatgttcagttcctgtcgaggttactcagagtttcatctcatggtctcatcatttaacatcaaaacacggcatgatcccatgacactacatattcttcaggtatttcctgagactttaagtggtgtgtctgtttgtgtgtgtgtgtgtgtgtgtgtgtgtgtgtgtctatttttaaataatttgtattttagatataagtcttacagtattctcctactggttaattaaagaataatgcttgacaaagattgagaaaaatcaatgtactaataaagatgaaaagcactacgatacaatttgtcaaggcaaaaaataaccatttggattatttccatatatataatatatatatggagtatttccatatatataaaatatatatatggagtatttccatatatataaaatatatatatggagtatttccatatatataaaatatatatatggagtatttccatatatataaaatatatatggagtatttccatatatatataatatatatatggagtatttccatatatatatatatagaaatatatacatatatatatacacatagagaaatatatacatatatatatatatatatatatatacacacatacactttttctctttggggggagcgaaactttttctgtcacccaggctacagtgcaacggcgcagtctcggctcattgcaacctccaggttcaagcaaatctcctgcctcagtctccttagtagctgggattacaagcgcaggccaccagacctgattaattgttctgcatttttagtagacatggggtttcgccatgttggccaggctggtctcgaactcctgacctcaaggcatccaaaatccttagcctcccaaagtcctgggattacaagtgtgacccactgcacccagctatagatacattcctaatttcatgcaaataataaatctgtattgaaattgggttacactttacattgtagtttggagcagatcacatgtatattttaacaaagctttcaggagcatgaattcatttaaatatcatcaatactaagtgttgttttcaacatttcaagccttcaatgtaaatgaaggaaaatctgaaaaatatatgttcaaaaacattcctttagaaaagtagacagtatttatttatttataattttttttttttgagatggagtttcgctcttgttgcccaggctggagtgcaatggcttgatctcggctcaccgcaacttctgcctcccaggttcaagcgattctcctgcctcagcctcccaagtagctgggattacaggcatgcgccaccaggcccggctaaatttgtatttttattagagatggggtttctccatgttggtcaggctggtctcaaactcctgacctcaggtgatctgcccaccctggcctccctaagtgctgggattagaggcgtgagccactgcacctggccaattttttgtttaaattataacagatgcatcacaatgtgcattttggctctctagaatacatatttgactacatgtttggtttaaggttctgacatgttagaagtagagtaacatacactttactttgtcatttatcttaccgtgtggtaagtttaatcctcaaggttctataatttttcttttctccctaaatcagaggcagggaatggctgtttatgaggccacagagaatgcaattaagatcttgtgatgggccaggcacggtggctcatgcctgtaatcccagcgctttgcgaggccaaggcaggtggatcacaaggacaggagttcgagaccagcctggccaatatggtgaaaaccccgtctctactgaaaatacaaaaattagctgtgtgtggtggcgcatgcctgtaatcccagctacttgggaggcagaggcaggagagttggttgaacccgggaggcggaggttgcagtgagctgagatcatgccagtgcactccagcctgggtgacagaaggtgactccgcctcaaaaaaaaaaatgtgaaggataaagggactatctggtgtagatgaatgacatgtacccaacctaaatgggaatgataggctcattgcccctccacactacctttcattgcagaataaaccaatcaacctccttgtcactaccactggaacttggctaggtgtgatttcctttccaggcttccatccactgcccaggcacatagcctctttattaaagatagttagcaaggggtgaataaaagaccacttagcctaaagaattctaggattggcaccaccagcctttctaccttcagatatgaggtactgttccataggtaggtctgtattcttccatgaaaatggtcgagtcaaactattcctccataggaggcagtttagcagatgtctaagtctattttaggtgaaatactctggggaggtaagatatcctttttgtcctttccaggaacaaggatcatggagaaatgcttcccctagcgtctccaaggcattcatgcatgccaatagtatctatgtctgcagatcatcattcaactcaacaaaaccagctagagagagagctagacacagtcaaagatgtcaaaaaagccaggctaccctagaatgccttaccctggaatgcctgcctgaatcctcagaggccaggagaggtcatacctgaacaagctcttgaagcactgtaatgtcacagtgcagaaccagactaacattaattcctttcattaagaattcagatactgaaataataaattctgaggaagaatgtcatgaggaataagtcacccatacaattttagccactcttattgattcctcaattatgagtcatagagtttctggaggtctccacaccaaaggttgtatgtcttcatcaggaaatagctttgaagctgatacagaaaatactagctaggatgaggtaaataatgatttgctcaggcctaaacaatgccatccttctcagggacatccaacagaagagagctacctatgtggcctccttgacagaaatgagatgtcatcggggtcccattatgacaaaagactttctcctgaacttataaagtcacagaagctgctggcttgtgcgctcagataattgcttaggccttccatcacattcttggccttcatccacttcagcaaatcggctctgctaaaagatgatctggcccacataggcatgtcagtgtatcctcactcctctatagaggtccctctagttgtaggcaatggtgtttagaatttttgtgtatcgaggaccatgtgaatgacactggcttcagatagattgtccctggaactgtcctgtccattgcaatctaacgatgctgctataaatgtcacagctgcataacacagggacagccagattgcctaaaactcccaagggcatattcataacataaatgccccaggggtctgcacttggctctgtcatcttctagtcttgtccccactatgaggaaactgaggccctgtcctctatttcctgtaccaggagttcctggaaacagttggcttagtcctggtccctcactcagcagatacttcactaagactttgcatttgtctattgcttatgctaggcctcagagaaaagggtaggaatgccaacttgtgtcttgggtggcttttccttccgcaactgctagggcttacatgcaggaaacgctcacggctttggacgctatgaaactatttccgcacgatggcagtattgtacgagaaaagccaactaactttgctccaggagctcttctcccgcccatcacgtttcaaaaaaaaggccaagaagagacaaagacaccagaaactatggctacctaacattttgctacatttgcgtaatggtattccacttttggcttctgctggatattaaactgaggtgtaatccactcaccctcatcaagcatctcctcttttcaagaactcagtttccgctcaaccaagtcttcccatttctactcttcttcactcagcattgtttctgcagtgttctattatgatatcaaattgtcttgtcgtattggggaccgacctcagggatccatgtctaaagagaaaggaaaaaaaacatgttgacatctgaggtcttggaggacagcaaatctgggcaccaggccacgtgtttcttctcctgactccctacccaggttccctgggaggtttactccatgttcagacctagtcagtaggccttgtatgttgagagggaggtcgctatttagtggggctctaacataagagtccagatagctctcaagcttgacagacacacacaaccctacttgaatgtacataaatacaggaatgactataaatgctaatcagatggatcccaggattttgtcttacagtttcattatataacagtgtaacacaaacattttcctgggtcattaaactgcaatggcttacaactatgtcctatgagtttgctgtgtatgtgtgttactgtttatcagttaggaatcagtcctgtattttcacattagtaacaaagaggtgggattcgcaaagaagctaaaaaaaatgtggtgatcaagagaaaagcaatgccatacaactgtgtattaaacactgaaggctgggcgcggtggttcacgccaataatcccagcactttgggaggccaaggcaggcggatcacttgaggtcaggagatcgagaccagcctgaccaacatggcgaaacctcgcctttactaaaaatataaaaattagctgggcgtggtgtcacatgcctataatctcagctactcgggaggctgagacaggagaatcgcttgaaccgggaggtggaggttgcagtgagcaaagatcgcaccattgcactccaggctgggcaacaagagcgagaatccgtctcaaaaaataaaaataaaaaacactgataccctttttcgtatttgctcccactttcaatacatagataaaagttctatatatacagtcaaacagtcaaacaccacagtaaatttacatttaaattggattcaggccaggagcagtggctcatgcctgtaatcccaacattttgggaggccgagtcgggcggatcacttgaggtcaggagtttgagaccagcctgggcaccatgttgaaatgccgtgtctactgaaaatacaaaaataagccaggtgtggtggcgagtacctataatcacacctactcggaaggttaaggcaggagaatcgcttgaatccgggaggccaaggttgcagtgaactgacatcacaccactgcactcccacctgggcaacggagggagggcctgtctcagaaaaaaaaaaaaaaaaaaaattggatttagctatgtattgtaaagtaaaaattttcattctaaaatttggttcctgaccaatttttgacattgtcatataaaatttgcaatttctatattttagacaataaattatttgcaaagaacttcgtgattatactagtcattaaaaaataagttgtttgctctttttaatctaaaaatgtgtttatatgtatataaacacataaatatttacatatcatataaatatgtatattatacatacttatacctctgaaaattaggattttaagattattcttgagattttagctctaattcttaccttcaaattttatctttaaaaactcaaaagaagcaaaacaacatccaatacatgataattgaattaggcatctctcacattcagtcacttagatgtgaaccctaagaaaactgtaagatggatgtattcacaccactcacatgcagctacaatgtttcattaatgtctgtttatataactatgaattaaagatatgaatttgttggccaaaaatatcatattcaaacatatactcactataacactgaccatgatttgaaatatatgccattggctgggtgtggtggctcgcgactgtaatcccaacattttgagaggctaaggcaggaggattgcttgagcccgggagtttgagaccatctcgggcaatttagtgagaccctgtctctacaaaaaatacaaaatatacctgtgcgtggtggcatgcacctgtgggcccagctacacaggaggtggaggtgagaggatcaccggagcccagggaggtcgtggctgctgtgagccacgatcatgccactgcactccagcctggatgacagggcgagaccctgtctaaaaaaatatatatatggcatttttaaatctgtatatgcatataaacagatatgaatacacacagtcccacacacattttacattcaatataattggattcatactgtttgcaattttgtacaaaatcttcggcatcaccttataatctttgaatatatccatatcaatatatacttttgagtgcttgagtttttttatattttactctagaaaaactttaagaaattacaagcagaaaacatatggtaggtcaaacctagtgagaagtaatcacttttaaaatatctatgctatgtattatgatctctttcctatgcacatataatatgtacatttataaactaatgttcaaattcccctgtagtataatcattgaaacaagttttcttcactgataacttgagtacttttcaaatgtaattaattattcttggaaataatgataggtttaaaaatattggcactttttgaaactgtgttggtaaaattcatgtaacataaaaataaccattaaaatgttcaaatttggtggcatttagtacattcacaatgcagtgcaagcactacctctgtgtagtggcaaataattttcattaccacaaaagaaaaccgtgaactcattaagcagtcattccccattccactctctgcccagctcctagcaaacactaatctactttccctcactactgatcatcacaataagtagccttttttctttcttctttcacttagcatgttttcaaatttcatccatgttgtaatatatgtcagtacttcatttcattttgtagctgaataatatccatatgtatatatcacattttgtttatccattcatcaagtgatggatgtttgcttatgttcaccttttgggtattgttaataaatatatacagtgagtatataaaagtacttgtttgagtatttgttttcaatcatatgtggtgtatacataggagtagagttgctagctcatatggttccttctatgtttaaatttttgaagtactgataaactgctttctgtagcaggtgcacaatttagcatttccaccaacactctagaagagttctaacttctccacctctccactgatatttgttctttttaagtaattcccattctagtgggtgttaattggtaccatcaggtggttttgatttacgtttctgaaaagactaataatggaagcatctttcatagaactgttggctatttgtatatcttctttggagaattgtatatttaagagctttgcctatttttaaaatttgcatataattgtacatatttatgtagtacatatattttcatgcatccacaaaatgtgtgataaccaaaaaaggataactgggatactcatcacctaatgcatttattatttgtttgtgttggaaacatttcaaatgttcttttaggtatttggaaataagcattaaattattgctaactatggtcgccctaagtatgctattgaacactagaacttactccttctgtccaactgtatttttgtagccattaaccaacctctcttcattcccctcctttcctaacttctggtatccaccattctactctatagttccatgagatggattctttcagctcctgcacatgagtaaggacatgtgataatttgtctttctgcatctggcttatttcacttaacgtagtgtcctacagttccattcatgttgctgcagatgacaggattttattcctttttctggctcaataatcttcctttttatatgtatgtcacattttcttaatccattcatccgtcagtgaacacttaggttgattctatatctttgctattgtgaataatgatgcaataaacatggcaatgcatatatctctttgctgtactggtttcctttcttttgaatatatactcagcagcgggattgctgcatcatacggtaactctatttttagctttttggggaaactccatcctatgtcccatagtggctgtattaatatacatttacagcaacagtatacaagcattcctctttgcttcctagccagcaactgttattctctgtctttttagtaagagccatttgaactggggtaatatggtatctcacatggttttgatttgcgtttccctgacggttagtgatgtttaacgtattttcatatatctgttggccatttgtgtctttgtttcagaaatgcctattcagatcatttgcccatttgtaaatcagataatttggtttttggttattgagctgagtttgttttacattgtgatttgttattccattgttagatcaatagtttgctaagatattctctctttctgtaggttgtctcctcactttgttgttttctttgctgtgcagaagctttctagcttgatttactctcatttgtctattttcgctttgattgccagtgcttttcagatcttatacaaaaaatctttccccagaacaatgtcttaaagcatttccccaggctcttattctagtaatttcatattttcgggtcttttcttaaatttgtttagccttgttctgtggcctaacatatgctctatactggagaatgttccatatgctgatgacaagaatgtatattctatagcaattggatgaaatattttgtaaaggtcagttaagttcatttggtctagagaacagtttaatttcaatgtttctttgtctaattaagctgtccattactgaaagtggagtactgaagtctcccagtgttgttgtacgccattctatcactctgtttagatcttcaaatgtttgccttatatatttctgtgttccagtgttgggtacatacatatatacaattgttatatcctcttgctgtattggcattttcattgttatacagtgaccttctttgcctctctttacagtttttgacttttaatctattgtatctaagtatgacctttctctctctctctctctctctctttctttctttctctctctttctttctttttttttttttgagatggagtctcgctctgtggctcaggctggagtgcaatggcatgatctcggctcactgcaatctctgcctcctggattcaagggattctcctgcctcagcctcccaagtagctgggattacaggcgtgtgccaccacgcccagctaatttttgtatttttagtagagacagggtttcaccatgttggccaggctagtcttgaactcctgacctcaggtcatccgcctgccttggcctcccaaagtgctaggattacaggcgtgagccaccatgctgggccagagtatagcctttccggttcttttttcattcctgttcattttcatgttgctgctgatgccctctctgatttgaggtcttctttgtctcagcaaaagacgagtccccaaatttaatgcactggggttgctagcttcgactccactttttgtctctagctgccctcagagatttttcttcctacaggcagtcaggatgctttctagggagtgaggcaagaacagcattcctgcaaaggacaccaaaatggtagagaagctagctgcctgcctggatctcacattttacagaggaaaccgtgagtccagggggaattttctacatggtgcctagcagctttgagttggggaatcacagagacagaagtctattaatctttccagctgctcatatgtattcactttcttgtggacccacagatcgtcatagtctcaattttcagttctgcaatattgcttgtgacaatcttggcactagacagctatttttagttttctttggggtaaagtcagattgcttccactctaccattttggtgatgtcactctcccttggcctattttttaaaaattgggttgtcttttgttgtttttaagagtcctttatatgtattggatattagcagtttttagataattgatttggaaatatttcctcccactccgtaagttggcttttcaagttctgaattgtgcactttgatgcaaaattttttaattccagggaagtccaatttattttttcttttgttattggtgcttttggcggtatagctaaaaaatcattgccaaatctaaagttttgaagacttattcctatagtttccctgaaggttttatagctttagctcttacctttagacatttgatacatttcaagttaatttttgcacatgatgtgaggtagaggtctaacttcatccttttgcatgtggataaccagttgtctaagcactatttcttaaggagtctattcacgtctcattaaatgaacttgataactttgtgaaaagtcaattgaccacaatgtctgggtttattttcagactcttcatctcttccattaatcactgtgtgtattcttatttgatcatcagcctgctttgattactctagattttctagtaaattttgaaatctagaagtgtgtcttccaccttggtttttcttactcaaagtttggttactcagatctcttgcaatttaataggatctttagaatttgctctttctttttcccaaaaataaatgctcatgggaataataattaggattacattaaatctgtagatctctatggctagtattgccatattataaatatttagtcttctaactcattacccacaggatgtcctttttaaaaatccaggtaatctttaagttcttctccaatattttgtgatttttcaatgtacaagtctttcatctgtttagtgaaatattctccttaaaatatgatttattttgatgctattataaatggaattgctttcttaattcaattttcagattgttcattgctagtgtacacaactataactgatttttacgatttaatgttctatcctgtggggcttgctgaatattgttcattagctctaatatggtttttctgcagtttaaagcatttttataatatcatcatctttatgaagagagataatttccattttttttttcttttttttcttttcaacttggatgccttttatatatcttcattgtctgatgaccctgactagaattttaagtgtacaagaaaagggcaaaagtgtgcattcttgccttgttcatgatcttgggaggaaagctttcagtctttcactcttgagtataatactacctgtagattttttataaatgccccatatatcgtgttgagaaaatgatcttctaatgatagattcttgattgttttgagttgcctttccagagagagggactacagaagttccctaatgcatacttttcattgatgtcactttcgccacctgtttttgaattcgtagaaacaatcatgcttcttgaaaacatacctgccacaatagtcatacatgataacgtgaagtgagatcacgggtaatgccatctccaacaaatactattaaaatgtagattgattttcagtccctttcactgtttttggtttatgtgtttatgtacaacagtccactagaagaagatgtaactcttccttgattagctcagtggttcaatttctctttatgcccttctagtcttcagacaattgggtgcccttgagaccctcagaaaacttacttgctcctgctacatcccacctggaattggtctgtccttggtgttctcacattgctgcaacaaatgactcatgcctcacagcagagtgacactgcctgaaagcctgctaactcttgctccaagggagaaacataacgcacccatccattccccacgtaggcaccgtgtaaagtctcaggaaatacttgaagtatatgtaacacatgggaatgttgttattttggtgttaaatgatgcgaccatgagatataactctgtgtaacctcgacaggaattgaacatatgcattatgagtatcattccatgtggagtatatgtggcgggcagcaatgacaactatcggatccctcctctatggctgatgccaaattactgcctatagtgcaacacatgaggctagaacatgaagaactccctggttgtctgggcggggagccagatcaaagaacaccagaatttgtaaattgcttgccagagaagatctccaagtttcaagtaattttctccttgtgccttcatcccctgaaaaagataattttataccatgaagtgtactggccccttaactctgtgaaataaatcgcaccctcaaagtcttggacaggaggatatttaatttctgaaagcacaagattcttaatgaaggcgggccttgtttgatttcaagtggaaaacaaaagcaaaagtgcagcggtaagaccagctggccccaaactgggctaaatgcaaggcagccatgtttggtggcgcctttgtggatgcgtggcgttttttcatacaggaagggcgggagtagagggcgccaagaccagactacttagcatatttggagcactactgccatcgtgaggatgtcgtttaacgaaaccctacgccattacagagttctagtgtgggctacctgttgggacaggtctggtctggtaagaggtggaagaggcttggcctctatgctgggaggcctcgcctactcctctaaggctttaaaaaagacctggacattggcggtatcttgctatagaacctggagtgtgaaggttctaatagcaaatcctgtaaacttcccttggaataaccctgttaattgtgcgcaacactcatgctaccagagacccaaagatccatagcaagatgacagctcgtggaaaacttctgactcttgctccaaggggcaggaacagcaaagagatgcccataagagcctacatgtgtctttgagagggtttctgctgtcctgcccacaccaggaggaactgaggccccgacccacgacttcctgtaccaggacctcctggcagctgctgcttcactccaagcccctcaatctccaggttctacaccaagataccgccaaattccagttctctcttcaggccttagaggagaaggcaacaagacctagtctggagcccaatcctcttccacctcctcacagaccagactttcccccacagcgaggcttcccgggaaggacgctgtaatagcctattctgtctttaaacgatttcctcacggtggcagtagtgcttcagattttcaaggacgccctgtcttggagcagtcttctcccgcccttcctgtctgaaaaaacgccacccagagacaaatgcgccaggagacatggctgccttgcattttgcacagtttggggcaacctgtgcaaattcctgtacttttgcttttcttttccatgtgaaatcaagtcaaagcctaaacgacccatcctcatcaggaatcttgttctttcaagaaattaaatgttttccagacttagtctatgtgggttggctcagtactttcacatggtatcaaaatgtctgtctcaggccggaaattagaccgatcagagaagaaaagcgataataaatggtcagaagcctggagatcatcatgagccaccaattcacaagtctaggtgatctttgacctattcccctccccagacaaccagggagtcctcctccattttctcagtttatgtgatgaattgtcagaaagtgtttggtagaagtaggaagagaaggccaagacagcgcacatcattgtatgtaatacattgttccacagggcatgatacatatacttacatctgtataaactcccattagaagttacacagttttggggcagatgcagtggctcacgcctgtaatcccaacactttgggaggccgaggccggtggatcacttgagatcaggagtttgagaccagcccggccaacatggtgaaaccctgtctctactaaaaatacaaagatgagccaggtgtggtggcccatacctgtagtcccagctactcaggaggctgaggcaggagaatcgcttgaatccgggaggtggaggttgcagtgagctgagatcacgccactgcactccagcctgggcgacagaatgagtgagactctgtctcaaaaaaaaaaaaaaaaaaaaaagatagttacacagttttaaaaattgtcctctgtttaacagtgaataatttatatttccacatgttcctatgccattaaatatttttcagcttcttcttgtgacttgagtgtgtgtgtgtgtgtgtgcctgcatgtgtgtgtgtgtgtgttacctcttatctcttaggtatcagtcttacaatatcttcttattagcaatggtgtttgcaagccaggtacagtcttgtgttcttgtagtttcagcttcttggaaggctgaggcaggagaatagcttgggcccaggagcagagcagcttgaagaacatactgacaccttagtctctaaaaaaaaaaaattaaaaaagaatgatgtttgccatatagttcaaaaataatcttgtgtacatcaagaagaataacaccatcataaaatctgttaagacaactgataacattttgggttattttcttccatacttttcaatgtatagatacatacgcctactatattttgttcacacaaaaaataaatctatattaaaattggattaatctgtacattgtggtttggatcagaccagatgtgtattctgacaaagttttgaagggaaagtatttgcttgcattaaatgcatgtacaaattctccttaacatcttgttttgtataaataagtacatacacacatacatacggatataggcacagatcatggtaactgaaatgattaccatgactaatcactaccatgactaatcactactatggttagtaaacatgtgtacacagataggtgtataaatatcataaataagtggtctctcaatcccaataggaaatgacttttaaaatggttttatcacacattcacgtcttctattggtcatataagaacttctctatttaaagttcccatatatttgtatgtccagtgttcaaatatgttctctacatttattgtagcttaaacatttgcaaacttgttaaatattcttaaagattattcttaaatattttgtgggatgccaggttgtttttaagagtgccttcctgtttttggcatttctcgaaattagatctgcttatttacaatattttcagatacagtagccctgtttaaagaaaagcaggtaggtcacagttaatgccaccaccaagaaacaagtaatttcaaaatgcggatctattatcagcattccctttctctttctttctttcttttcttttcttttctttttttttttttggcagtttctcgactttattagcctggagctcctctccgacatccccaggggctggtctctggtccctgggcacagtgagcaggactgaggtcagacgggttcagcccctggccatagcagcttgggacagctgggccaagggaacaacaggtgcaaaagtccaaatgctggcacttcaggtgtggccggcacccagccaggcgcaacagtggatgggcaggacgccatgctcctctcctggcgataggtagaccatagcagcgctccctcccagcagccgctaggaacagctggtgattctagccaggaagtgctgcgcccaccactcgtccaagtcaatgggcacgaagttctgcagccggggattggggatcctctccactgcacaggccttgtcccgccctcaccggctgggccaccatccagctgctgccgcacctgctgccaggcttcggacacaaagcggacattctccttgtgggccagtgtgtaggtctcctgggtcccctggagggatggggacttggaggggtcccgccggcgattcacacgattgaacacaagccttggccctgcactcgacaggggccagggtcccagcggctgcgcgaagggctgcgcccgctggggctgcaaggtcggcggcgcgggctgccggcttttcaggagctcctggagctggcccttcacctgctgctgcgtgagacctgtgcggcgctgcgcgaccaacttgctgggcccgttgatgatggtgtacatggcgcgccgctcccagactgccgccggccccccaccagatctcagtattccgtttttctatgtttcgaagaaatataaattactgaattccatctgtggtcaataaggattttgcaccaactgtttcagtacacgtttgttcttgattgcttctcaaattatgaatatcagctttttgagaaatctcttagaatattcaaatctgtgaaggacaagcaaaaacacttcatcgtaaatcccattttcatgaagcaaccaccatcagcagcttgatggctacatgcattcaaatattataaatggattctatgattgttcatgagaggtgatactatttaactaaagcgatagaggcttattaatatactcccttatttgcacaacaaagtgttcaacatacacacacaatcacattaattactcccttcaattccatcctcatcaaactataggtagtatttaatgccttgaatatttcacacaatattaggtaatgggaaatttccaatggcatggagtaactaatagtactttattgctaactctcataacatttctttattgttcaaaaataacaatgaatcaactagtgctcaaatcctaaggatgatataaacacttagcaaaaaaatgaaaaattgaacaattatagcagaagttaatgagacatattctctatcacataaactcaatcaaaattcaattactgtttttctcaactgcatttagctcgttcttctatttgcattttattggggggggtagagggaatgtacatgtgcaggaatttttttttgttataaacatcaaataacaccctttatgtgaaatttccttctaatttaatatttttccttctatcatttttctcaggttttatatagaaagcctacttaaaatgtcactaaacatacttcagctaattggattttgtgttaaataataatttgttagaactttttaattttcttgactagtaagagcaagacatttaatcatcccagcatgtaaacagtgctgtttatttttaaataaaaacatggtattactcagaatgttatcagtactaagccttatttgtcaatgtgtcaagccttcattataaataaaagtaaaactggaaaatgtgctctcaaaaactcagctttagagaagtagacactgttagttgttttgtttgaattttttcaatttacagatacattacaatgtgcatattggctttctagaatacatacatgtttagacgtttggttcaaggttatcacatgttagaagtaaaatgcccttgactttgccatttctcttacctagtgttagcaaacttacatggtttgatccccaaggtccaactgtttgcttttctccctaaatcagaggcagggaatgtctctgccaatcaggccacagagaatggaattcagactttgtgaaggctgaagggattacctaaggagcctaactcatctagtcaaggctttctgtgagtgttctttagatgatatttgaagggaaggttagaggtcatttttctctttcacaaaatacctggaagacctcgtgctttgcttcccagagcctctgcaaggcactgctgtgtgtcagtacacctatgtccataggccatccttgaaatcaaccatgataagtcaaaaagagagaggcacaggccaggatgtcacaaaagccagttcccttctcctggtacagcatggtctacatggtaggtgatggaatcttacctttcaaggtaagatatatttttatatcttttaggtctagttgactcataactttgttcacatcctctaattccttaatgatcttcagtttagttgtttcattcattacttaaggtggggtattgggctgggtgacgtggctcacgcctgtaatcctagcactttgggaggctgaggcgggcagaccactcaaggccaagagttcaagaccagcatggccaaaatggtgaaaccccttctctgcgaaaaataaacaaattagctgggcacattggcgcacgcttgtaatcccagctactcgggaggctgagacataggtattgcttgaacccaggaggcggagattgcagccaagatggtgccactacactccagcctgggtgacagagtgagagactctgtctctaaataaataaataaataaatacataaagtggggtattgaagtcactaacttactttttagaactctattttttcctttagttctgttcagtttttgcctcatgtatttggggactcttgtaaaataaatatgtatgtttaattagtacatcttgacagactgaccttatcattatataatgtccatctttgtctcttgaaacaattattgtcttaaggtatattttgtctggtatcagtacagtcagaccaattttcttttggttactttttacatgaaatatttttttcatgctattactgttaaccatttgtgaattggatctaaagccaactcttttagacagctagagttggatgttctaaaaaatccattctgccaatctttgccttggagtttaatccatttaaagtaattactggtaaagagggacttattcctgctattttgttatgtattttctgtatgtcttatagcttttttctcaattccataattcctaccttcttttgtgattaattgatcttttctagtgcaccatttttattcctttctatttctttttctctatatactaatttttttctttatgttatcctgcagaatacaattaatatcttaattttagagtaatcaatttttattaaactacaaagtagtttatatagtacataaaacctactcctttaaagctctaatcccttttgtgttatttttacaaacgacatcattaaacattgtgtacctattaatgcagacttataattattgtttcattcatttgtttttaaaatcatatgggaaggaaagggaattataaaccaaaaatataattcttctggcttttttatgtatctatgtagctacccttttctttgttccttatttcttcatatggttttgagttactatctagcgtattttcatttcatcctgagagactcctttttgcatttctgttatgggaggtctattactggtggaatctgtaagtttttttctatctaggaatgtcttaatttctccttcatttctgaaagttagtcttgggggatatggaattattgacaagtttgtttgctttagaacttcaaatatgttatcccactgccttttggcttccatggtttctgaagaaaaactggctgctaatcttattgaggagtccttgtatataattaagccctttctcttatgatgctttcaagattcttgctttgtctttgtcttatgacagcaggattataagctttctcattgtagatttcttcgggtttatcttacatagagtttgttgagcttcttgcatgtttatattcatgtgtttcaattgctctagcttcacattcactgacttttttctaactgttctaatctgctgttggaaacttccagtgatcttttttttttcatttcagtttctgtacttttcagttccaaaagttatatttgtttttttaaaaaataatttctctctctttattgatgttctctacttggtgagacattattctcttggtttcttttagttctttgtgtttcatttatggtaacactttgagcatatttaagagagttgacataactcttttctagtaagcccaatgcctgggcttccttctgcacagtttctatgaatttctcttttccctgtgagtaggccataccttcttgttttctttgcatgtcttatgttttgtttatcattaaaaattaaatgttttgggccgggtgcggtggctcacgcctgtaatcccagcactttgggaggccaaggtgggcggatcacgaggtcaggagatcaagaccatcctggccaacatggtgaaacccgtctctactaaaaatacaaaaattagctgggtgtggtggcgcgtgcctgtagtctcggctactcgggaggctgaggcaggagaatgacttgaacccaggaggcagaggttgcagtgacccgagaccacgccactgcactccagcctggtgacagagcaagactccatctcaataaataaataaataaataaataaaaataaaaattagatgttttgatatcatactgtatcaactctggaaattagatttctaaacacacttgcctccccaccccatggggttagttgatagcagttgtgtgttgttgtttgttatttgcttttttagtaacttttcttaaatatttttgtaaagtctgtatttttatcatttgtagccactggagtcagtgttctgatagcttagtggtcacctagtactctgacagtttccttaaacacgtggagcctaagaaagaaagaaaagtagctgggtgcggtggctcatgcctgtaatcccagcactttgggaggctgaggcaggtggatcacctgaggtcaggagttcgaggctagcctggtcaacatggtgaaaccctgtctctactaaaaatacaaaaattagctaggcatggtggcgcaagcctgtaatcccagctactctggaggctgaggcaggagaatcgcttgaacccgggaggcggaggttcagtgagccgagatcgtgccattgtactccagcctgggctacaagagcgaaactccgtctcaaaaaaaaaaaaagaaagaaagaaagaaagaaagaaagaaagaaagataagtattctctaagtccttgaaaactggctctgtgtgttggggcactctttcaactagccaggctgtagtcttcacttctagcttgcaaggggcctgaaagctagtgagatctgagaccttaagctcttctcaggcattttctgcataattgtccagccctgcccatgtgcatggctttcttatttctctagtgtatacaagaacattttaaagttcttattcccccaagtatttcctttcatagcctcttccttcccatgcttttccatctgcttattgtttattttaactgttgtcccttgcctcagattcttatagccagtacttgtgtctttaagttttttcaacacatgcccctcaggagttgttccaaacttggaaacactccaagtgaggcaaaacaaaaagcaagctcttacaccaatcctttagggagccaaaagacagatcaaactggaatgcaacaattctttgagaataagttctgtattatacctatgcacgagggtaggagctatactgaaggcactgtggaggctgggggatggtagacaggtaatttaaaatgccgcagctctcttgctctctcaccacaaagcagtcacttatttcttcaccaaggcttccctgggtgttgtaagtttttgacaagctctagagttctgtaaaagtggattctgacacttctttctttctttctttctttttttgagacggagtctcgctctgtcgcccaggctggagtgcagtggagcgatctcggctcactgcaagctccgcctcccaggttcacgccattctcctgtctcagcctcccgagtacctgggagtacaggcgcccgccaccaggcccagctaattttttgtatttttagtagagacagggtttcaccgtgttagccaggatggtctcgatctcctgacctcgtgatccacccgcctcggcctcccaaagtgctgggattacaggcgtgagccacggcgcggggccgacacttctttctagttcatgcctggctcttgctgcttttgtggagggatgatgtgccaacgtgtcctccttcatgatcttcagtgacatcatttttgccacctgatttttgcacttctagaaataatcacatttctttgcaatgttccttctacaacaggcatgtatgaagtcatagagtgatatcacaaggaatgacacctctggcaggcaaggacttggaaatatgtgttcattttcaatccttttcactgtctgtgttgaaatagcttagtcatatgtaaaacatctaaattagattgaattatacttcagtttttgtttatgcttggctaacatatttggattacttcttctccatctgttttttcatatctactcctttagacgtttcattacttcttggtttgactacgtggccccacttctcctcaattcctcctggctgcaggcagtgaatctagatgtttgacctgagatcttcagcaagcacacttgcctctgcaatgtcatctggaattggcctgttctttgtgttctgacacagctgccacaagaaaccaacgtcccatagcttctttgaggagtccttgtatataataaggccttcatcataggatggtggtaccacgtgaaagcctgctaactcttgctccaaggggcaggaataggagacagatgcccaaagagcttgcatttgtgtttgagtgggtccctcaagtcctgaccacaccaggaggaagtgaggccccgccccacgacttctgtgccagtaccgcctggcagctgatggttcactccaagcccctcactctccaggttttataccaagataccaccaatgtccaggtctctctgttaaggccttagaggagaaggcaaggaggctcagcatgaagccccagcctcttccacctacccacagaccagaccttccccaacagctgggcctcaagggaagaacgctgtaatggcgtattctgtctttaaatgatttcctcacaggggcagtagtgctgcatattttcaaggaaacctgccttggggcactcttctcccgcccttcctgtgtgaaaaaacgccactcagagataaaggcgccaccaaacatggctgccttgcattttgcccagtttggggcgacctgctcatactgctggaattttgcctttgtttccatcttaaatcaaaccagggcctaaactacccactttccccccccaccccccactaaacactcaataactttatttgcctttggttggctcctgggtttggggcggggtaggggttggcagcagcccgggcttcgtgcgccctctggtggacctcagaggcaagaactggaatcccggccaaacctgaggacttcacagtcaatagtttaggagagttgcatggttcctcaggtctgcagtccagacccaacaacagtggacggggcacgttgggaggaggccctgaacctctggctctcatactcgccagtgttggacacccgcatgttctgccgagccctcatctgtttcacacggtccttgtccacttcctgcttggtgaggatgaagagaaggataccacaagggaagccgatggcccaggccagtcccacagctttcatggggttcttgcccctctttctgggaatgtattacatctcgggggataggagttcaggttcctccctgccttcttgggagctgtgggtttgcagtgcctgggtcctgttatgggaagccttgttagctgtggctcctgcgagaatcccccggaggacgcgggcatttcttgccctccatccccccggcccttcagcgccttagcagctaccaccaccgccatgttcagatcccaccctaaaccacccacttttatcaggcaatattatctttcaagaactcaatttccacttaacctagtctttgcagttctgctcttaactcagttttacatctcaagcattttccctacatgatcaaattgtttacgtctaggggcaagtctcaaggagctaggcctaggaggaagacgacaattttgaaaaattaagggcaggattggggcatttctaggcagcaggccacatgttccttaacttggcttgctattgttaaagagaaaattattccagcacctgttaaagtgataaggaagactattcaagactactgcaatagggacattgcaataggtgagaaatagatcagtctccattctgagcatagcaaagacagctggagatttatagtcaaggagcagagtgaggggggtcagtgcatggaacatcacagagaggagacatcaagggtaggggaattcttgccaaactgagttaagattcttattaaaactggactaggcaagccaaagacaggactcaagaatgagctgttaaaaagagggctcagaggagcctatctacaatttggtcaaggagatagcctttgtcaatattcatgccctcaaggagtctttctccatttacggggttagactctgtaaaatgagaggcaactgtttgcttggagccctaagaggaaggcttagataccgctcatcacttcatgccataaatgcccactttgagtagtatacatatataaatacgtataaacccctatcagaagttactaaaaggttgtctcatgatttcatcttttaacctgggaacacaagcactttctcatatcattaatttatttcactttatttttgtttgttgtcattgtatttcttctcatttgaaattagttacttagtttcctcagaaagttaaggaaaatattcattgaaataaatgacaaatattactgaacagcttagtcatatttcaacttgttaaatagatttaggagtaattcagtttttgtttatggttggctataatatttggaccatttctcctccatatctctccaatggaaacaaaatatataggacgaaatacaaaattctccttaaaagtgtcaaagaattcacaaaagagaaagtctcagattaaaactctaatagagagaattaacgggaacaccagattacccagtctttttggccttttgggtatttgcttacctgggtagtattggccttcattttcagggacctcacaggtggcaaagagcagaagatagaaaaagcctgaagggaagtataacgattaaaaaataaaacacacttagggattttcctttaacacaagcacttatcccacatggttacaggttggttctatgaattctttttcttttttttaagatggagtttcactctttgtgcccaggctggagtgcaatggtgcgatcccggctcactgcaacctccacctcctgggttcaagtgattctcctgcctcagcctcccaagtagctggattacaggtgcatgccaccatgcctagctaatttttgtgtttttagtagagatggggtttcgccatgttggccaggctggtctcgaactcctgacttcaggtgatccgcccgcctgggcctcccaaagtgctgggattacaggcaggagccaccatgccgtccggttttataaatttttaagcaaaagatgattccaatcttattcaaaatattttagaggggaaatagagatgaattacttcccaacatattctgagcaacttttataacattggtacctaaatcaaacatagattgtgactgaagagaaaaatacaaactcacttcaattataagtgaagacttaaaaattgaaagatatgagcatatttaatccatagttctgtaaaagacaataaactatgatcaacttggatttatctcatgactgaaagggagttaaaacagtgcaaaaggactaaatgtcatacaccacttttccaaataaaggagaaaagtatatggtcatctcgatgcagaaaaataaaaatatttggtaaattcaacagcacttacaatataaacttttaggaagccacgaatataaaggaacttccataatctggttattatatcatttaatcattgctctgtgaaaaactattttttaactcagtggcttaaaaaacaagcacttatcataactaaaaaatctacaagtaaggccaagtgcggtggctcacgcctgtaattccagcactttgggaggctgaggtaggcagatcacctgaggtcaggagttcgagacagcctggccaacgtggtgaaaccctgtcactactaaaattacaaaaattagctgggcgtggtggcatgctcctgtagtcccagctactcgggaggctgaggcaggagatttgcttgaaactgggaagcacagattgcagtgagccaagatcatgccactgcactccagcctgggcgacagagcaacactctgtctcaaaaaaaaaaaaaaaaaaaaaaagaatctacaaatatactgtgttgttgttatcatggtcttgcctggattgtcaagcatctggcatcagcactgggtcaggttggcagctctgctaatgctatctcttacatgtttgggggtaaattcactgtagagactgctggtctctcctccccatcctgcaacaggccagcctgagcatattcatacactggtagcaggtttgcaaggaaaagtggaagcacacaagtcttgtgagactcagagctgacacaccatgacttcagaattttattaactaaatcaagtcacaaagacagcccagattcaagaaatagggaaaaagagtccacctttttcctggaaaaggaactgaaaattcacattcaccctaggaggagaatttaggacgttttcatgttcaatttagtagagatatctacaaaaacctacatctaacataatgcttaatgggaaaatagctaaagaattcctttcacagccatgaataatagaaggctactcaattatagcaattctaccaaaaagagtcctgaaggcaatgaaaaaagaaaaatgaaatgaaaacaggattagaaaagaagaaaagtaaaatgtgatatatattgtataattttatacatgtgtaaaataagagaatacatcaaactgggcataagatcaatatataaaagtaaactgtatttctatatagcaaagggcattagaaaacataaatttaaagaagacaccatgtgcaatagcatcaataactataaacgaactagggataggccgggctcggtggctcacgcctgtaatcccagcactttgagaggccgaggtgggtggatgacctgaggtcaggagttcgagatcagcctggtcaacatggggaaaccctgtctctactaaaaatacaaaaaaattggccaggtgtggtggcaggcatctgttatcccagttacttgggaggctgaggcaagagaatcacttgaatccgggaggcggaggttgcagtgagctgagatcgcgccattgcactggggcaacaagaatgaaactccgtctcaaaaaaacaaacaaaaataaattaactaggaataaaagatgtgtaagacttttcatttgaaaatcatataaaattgctaagtaggccgggcacagtcgctcattcctgtaatcccagcactttgggaggactaggcaggcagatcacctgaggtcgggagttcgagactagcctgaccaacatggagaaaccccatctctactaaaaatacaaaattagccaggcgtggtggcacatgcctgtaatcccatctactcgggaggctgaggcaggagaatcgcttgaacccgggaggtggaggttgcggtgagccgagatcatggcattgcactctagcctgggcaacaagagcgaaaccctgtctcaaaaaaaaaaaaattactaagtaatagtaaagaagattgaaataaatgcagacaccatgatcaaacataggaaaatgcagtatcataaaggtatcagttctatgacaattgatttattggttcagtactactctatttatcattgcaaaatgtccgtctttttatgttttagtgcttttcacttcaaaagcgcatttctctgatattaatattggtactgctactttcctttggtatgatatttatttgccccaaccttaattttcaaaacttcctataattcttggctttaagtgacttaatttttaaaagcactgtatagggttgtttttgttattgttttgcgttttgtattttagcccaatataatgacttctgtcttttgaggagataattgtgtccactcacgtttactgtaatgaagaaaacacttaactttattcctgccttcctacattatgtttattacttttttttccacttcatttctgatgtttgagttgttgattatatctttttaccaattgttaatttccattaatagttaccttcatttctccatgtctaccaatagccacatatttttctaatgttgcccgaaacaaagtactataaagtcccccaaagcacactatttcttagctcaaggtacctaatattcttcctcaaaactaacccaagatgttgtgtccattaaaatatgtattccaattcgtccttttatattttccccacttaaaagatttgttaaaattctttaatatttttattctgtactcatgttatgtcctttgcagtatagtccctcaattatgactatttagagtgcttatgtcttccatttatgaagagtgtaaggtctttattcctgtttctccttcttcatccacttcagttctcttttctggaatattcatttggctagatttcttttttttctttttttttgaggcagaatgttgttctgtcacctgggctggagtgcaatggcgagatctcggctcactgccacctctgccttccagtttcaagcgattctcctgcctcagcctcccgagtagctgggattacaggcgcccaccaccatgccaggctaatttttgtagttttagtagagacggggtttcaccatgttggccaggctgctctcgaactcctgacctcaggtggcccacctgcctcagcctcccaaagtgctgggattacaggcgtgagccaccgcgcccggccatggctagatatttattcaagtattatccttatacaggatatgtggatgatatattatctgaaggtttccatatgcacaaggaacttctgttcagcctgactgatgaataatttcttggctggagacacacaacggttatgttgtattctctctctcctaatagtctatagatgttattccattgatacttgtttgccagtgttgcagagaagtcagaatggagtctcattccaatatttcttttgtaagttttaatttttacctgggaagattataaggtgactttttaataattctagtattttaccaacatatgcttagtgcatatctttattccgttctataccacagtgagactctacaatctgggccttcttcaattgtgggaagttttcttctacttgttgccttaaattttgccttgtttattctgttttttccctattgtaacatcttttagtaatatgttaaaaccttagatctttaaggttattaacttttccttatttttcccattgctttattttttcctttgttttgagatatgttatgcagttgatccttctagcctgtcattcaatgtcagttgatctccctttcaaaacttttcctaatggtttagcattttcctaaataaaggcttttgggaggcatctgaatcttaataatttcatatttgttttttaattcaagttgtcatttttctcatctagctactgtatttgctgattcaaaggttggcttgttcagaggctgttaggggcctaaggctgcttatgcctcttaagtgggctacaatttattttgttggagttattaagtaacaagtagctgaaattccacaagtggtagagtataaagtgttctttactcctgtcagctactggaataccaccatcaaggacaatagctaacaaatatcgaacacttaaccacataccagggaatattctaaggatctgaatacaaattcatatatttattctttacaacatccttctaatgtaagtagtatgattctagccacttacttaacgaggacagatagcaaataaagttttttttgtatttgtttttttttgttttgttttgttttgtttttttgcgacacagtcttgatctgttgcccaggctggagtgcagtggtgtggtctctgctcactgcaacctccgcctcctgggttcaagcgattctccttgggttcaagcgattctccttccttagcctcctgagtagctgaggttacaggcaactgccaccatgcccagctaattttcttttgtgtttttagtagagacggagtttcaccttgttggtcaggctggtctcgaactcctgactttgtgatccgcccgcctcagcctcccaaagcgctgggattacaggcatgagccatcgtgcccagctgcaaagaaagtttaaataccttatgcaaagtcacagaagaatagttagaaacaaattttaaaatcggattagtcaggcttcagaattcacattcttaagatctagattaggcaaactgtcagctcacttccaaggcactttgaggaagcctcccaacttttattggttttcttgcattctccaagtctcaggtccagggaggactcaggtaacaaattcagttctatcttgtattcttggcataggggaacaactggcaaaaataagtccgactcagttgaccttccaattattagtccacctgtttatcaggccaagccctttccacaatctgttccttttcattgcaagctttaaaaattctggccaggtgtggtggctcgcgcctgtaatcccagcactttgggagggtgaggcgggaggatcacgaggtcaagagatcaagaccatcctgccaatgtggtgaaaccccttctctactaaaacaaatacaaaaattagctgggcttggtggcatgcgcctgtagtcccagctactcaggaggctgaggcagaagaattgcttgaacccaggaggcagaggttgcagtgagctgagatagcgtcactgcactccagcctggcgagcagctcaagggagaaattcccataaagaccccacttatccctagctacctataggcccaaggacccctttggctcagaaaaaaaaagataaattagagttgggaatgtagaaatatacagtcacattcaggttctaatgttttaatttttaaaaatgccgacgttgtttaactatatttatgggtatatgggtattcgttaaggctgtttgccaaatatttcaattactcctcctagatactgttaagatagtggtatttggctaagggatggagtcaaaaccatagatctgattaaataaatacctaacctactcctgaaatcctgccagaatcctttataggagaacataaccaggacatagagcaaaacagccagattacatagtccatacagattagccatttgatacacagagaagtagagaaaaatgaagagtggattaaagaggagaaaatagaaatatcagggaaaaaaatccaacatacgctattatgcaattggtgtttaaagaaaaaatacatacagattatagtaatacgataggtcattttgtgttcacttatctgaattccatattttctaaatattctgtattgagtctattacttttaattttaaatatttctacttataaatatttatataaataaaaatatttctatttcttataaataaatagctattttcatatttttaaattatacttttggataactaaagtacaactgtcaaaatgctcatactataaccaagagaaaaagtataaaagaaaaaatatgcaggacaatgcccaatttttgtaaacatgtatgtgtatatacaaattaaaatttatcggccaggcgcactggctcacacctgtactcccagcactttgggaggccaaggcgggccaatcacctgaggtcaggagttcgagatcagcctggccagcatggcgaaactccgtctctactaaaaatataaaaattagctggtcacggtggcacacgcctgtaatcccagctacttgggaggctgaggcaggagaatcacttgaacccaggaagcaagaggttgcagtgagccgaaattgcgtcactgctctctagcctgggtggcagagcaaggctctgtctcaaaaatagaaaaaaaaggccgggcacggtggctcatgcctgtaatcccagcactttgggaggccgagacgggcagatcatctaaggtcgggagtttgagaccagcctgaccaacatggggaaaccccatctctactaaaaaaaaatacgaaattagccgagtgtggtggcacatgcctgtaatcccagctactagggaggctgaggcaggagaatcgcttgaacctgggaggcggaggttgcggtgagctgagattgtgccattgcactccagcctgggcaacaagagcgaaactccatctcaaaaaaaaaaaattatcaatatatttaggtaaataaagcataaagatgtgatcagtgtttgtctcaagactgtggaatgataaatagggtgaacattcctttcagtgtgccttaggaagtcacggttcacacagttgtccaacttggacaataaattatacaattatctaaggaggatacacaatgtacattctctacctaactgcccaattaattatttaaaatgtgttgtttctttattcattcaaagcatcgtgtatgtgaaaattaaaacatgaatatatgaggcataaaaatataaaagtgtaagaaaaggtcatacgataaagttgataatgttttaacatattagttcaaaacctatggaacagcttaactctgatgtctttaaatgataatagctaaatatgagtatttattttgaacatcaagtttgagcaactgaaatatttattagtgagttctccatctggaaagacatttaaaaagaaggatgccattttggttactttctaaaatatgtgagccagaaaatggagtacgccataagagcctgggaaatgagccaggtcaaagaccacaacgtctgatggagacagatagccaagcctcatacaagctttggagttccagcaatatcttttcctcatgcacggactccttgggacttgaaccttgtatcagaaaacttgaaaatggggaaaatcctgcatatctaatggtgaccgatgaggagatctatgaagctgtagtagaggaaactgaattactgaaaagaaaagatgcctaatgagagtgggtggttttaggcttcagtttgattgtatatggaaagcaaaagcaaaagcgcagcggtgtgagcaagtttcttcaaactgggcaagacacaaggtagccatatttcctggtggctttgcctgttagtggtggtttttttcagatggaatgggagggagaagaaggcctgggggcagggttagttggcttttctgggcccatactgccatcgcgaggaagtagtttgacaaaagcaaaagcttcgggtttgaacttccctcctatctagcagttaagaaagatgtagcaaattcaaaggttcaacagggcctgaccccaagatgggccttctcaacttcaactcttaggctttccaggagttcagtctggacaaaggcaaaatctcagtgaagaagctgctaagtaaggtaccaggactgatgcagggctttggtttcctctcactgtgggcaggactatggaaaaactacagtctacacacagcttctgggcattggtctcctgaccctgccccttagaccatgagacatttgggctggcacaagatatccctgtactttggggtatgggccccaatgttagcaacgttagaatgtgaggagggggaaatgaatctcattcgaggtggcatctaacagcagctggaggtctcagggacaccaaaagtctggtgcctctgttgcctagagcaagaaggatctgaggaaaaggagcatgtgtcactgtgccaagtcaataaattccagaacatcaataagagtgcagatatacacaaccagaaggcctggaggtattctctgagcccaggagttaacagctgtagtggctttgcagcatttttttctagggtccattgtgaaggcatacccacgtggagggatctgctctcatttcatctctcttaatgggacagaaatggtttctttagctttcttctaaggaagatgaggcttttaaggctcaggatctaactgttcattaagattagcaagtattgttctctgtgcctgctccttagcctttttctgatgaagattccttgtaggcctgacaagatatccttcagggagttgagtacatcaggacccccagaaaacttgcctctttagtaccactctttcgtaccagggatgatctctgtacatgatcctttagagaaaatgctgagcagtccatgaaaacaagcatgagtattttgatattctttcttctgctctcttctaaatctattccatttgaatatttgcatgagtacgtgtatgtgtgacactcatgggtttgttggtatgactttaggcttccccatagtttgcagatctccttgggttttgaaatttttccttttccttttcccttttattataaggccaccgcatgggtcattaaatatccttcggatggttggattttgtgttacttataaatttgcccaaagatttttgttttcttcaccataaaaagtgattttttaaaatttccatatgtaaacagagcaatgtataattttcagagaaactgattcttacactgaaggctattttaaaacctgaaaggtatacctttgtttcttgatttccaatgtaaactttgcttgttactatttcaaacgtggagacatgtataacgttaatacttgagggcatggccttaaaataattactccaggaaggtagacacaatgagtatcttcgttagaagactgcaaattcattctttagaattcatatatatgcactcaacttacagtagtcatacatggaataagtagagagagatagactttattttttcctttgttttctctttttttttttttttttttttgagacggagtcttgctttgtcgcccaggctggagtgcagcggcgggatctcgactcactgcaagctccgccttccaggttcacgccattcttctgcctcagcctcccgagtagctgggactacaggcacccgccaccatgcacagctaattttttgtatttttagtagagacggggtttcaccatgttagccaggatagtctcggtctcctgaactcgtgatctgcctgcctcagcctcccaaagtgctgggattacaggtgtgagccaccgcacttggcttgttttcttgtattagtaaactaggatggtttgatcccaaagagtcaataatttgctttaacccctaatcaaagaggtggaatatctttactgatgtggacactgagaatggaattcagtcttttcaaggacttaagaggactacctggtatagctgaaacatgtggagtcaatctactagagaataggccctttgctcctccccactctctgacattgcagaggaaagctgaatgaacctactcatctctgcactcctgtctcctatgggaatgtgaccttgactctggacaaagagtgtgctcatgtgaaaggttaagtgatgcacacatattgcccaccaaatagttaaaccaattgacaatgcttcccacctcacgggaacttgtccaattctacaaatgttcacacaaactaggtgttatcagtggtttcatgttcagtaacttacttagggatattttgaagaggtggggaatggttgagactttgtcatactgtaatttacttgagtattggtgaatttgagaacctctgccaatggactttgttgttccatggcctttttcttctgcgaagtttgtgcctggttccttttctctttccttgctgaattgtttctctttaacttttcatcttggaatagctaatgatctgtaatggatgtcaatggttgaagggcagtaaatactgacaaacaattgcttgtagtttcctgtttttgctgttatttttattatgcctgaaacaatgaaattgtttccatcggcaatcaggcctgttagcctctattaagtatagccaggtgaggtgagcacaacattcttgagcctgaggaattcctgagctgaggccactgctagtgccatccacagttctgtctcaacacatttgtctaccctacttcaaacatacgacctagtcaaaatgcagctccaaggcaggcacgctaacccatctagttcaggccttctctttcggctgttttaagtgagatcaggagatcagcaatgacctctcaccttcacaagacatctgggatcattaagggatgctttaccacatgtctccaagacactcctgagagttattgacccttcttgtcagttatctattgcctctcagctctgaatgcattcttcaatatatgctctacaataaatagtgggaattttccccctgtactctgagctccaacactactgccaaatggggctcatatcccaggccccagtgtgctagaggactgtgtcccagactgtctgcctctacaacaaggagcaggggcaggaggcaaatgatcagaagccctgcacttagcagtaaactgcttcctctagttcttcctgtactgggaggacacaaaagccccacctccaggacttcctatgcatgaatttcctgcctactccccggtcagttctggccacttctacaactatatcacacctttgtccacagattctagaaggtctgagagatgaaggcaaggacatcacgcttgaggccagaagccgtcccaacttccccacaggtgcaaccttccttgacatcctggttttttgggaggaattgttcatggcttggattttcatcaactgatttcctcacgatggcagtagtgctccagaaatgtcaaccagccctgtccccagggcctcttctcccgcccatcgagtatgaaaaaacgccaacaaaagacaaaagcacatggaaacaaaactgtttcaattcttgcccagtttgaggaaacttgttcacaccactgtgcttttgctttctatttccatcttaaatcaaaatgagtccttaaccaccccgccctggtcaggctcttccgttttccagcattaaatttccaccagatctttggcttcacagttcagctcttcttctctcaacattagttcttcagcattttctcaatttattaagttgacttcttaaagttgaacaagactcaggattccaggatgaaatgggagaagaaaacgccgtaagttccaggcctggaaaaggtcatctctagtcacctggcatcatggtccttgacgcagctttctaggttaccagggaatcttcctccattttgtagcagacactaatctttttgtttggtggaaggctgttatttggccgaattcctgagattattttcttatagcctatatagctctcattggtttgacatgtcatatgtgacataccaaatgtacctttatatttatttatttattttcgagacggagtctttcactctgtctcccaggctgcagtgcagtggtgcaatctcggctcactgcaaactccacttcctgggtccaagcgattctcatgcttcagcctcccaagtagctgtgactacaggaacccgccaccacgcctgactaatttttgtgtttttagtagagatggggttttaccatgttggccaggctggtcttgaactcctgacctcaagtgatcctcccacctcagcctcccaaagtgctggatttacaggcatgaaccactgggcctagcctgttcttaggaaactcttaatgaagaaatgtattaaacaaaaaggtgagttcttatctaaaaccagttttcagatgtaacttttctttgcactttggtgtatctattttttcatacacttaaaaacatatagttattcagtacatctgtcatgtgaccaatttgtctttgtaattatcaatacacttcttacaatgctaaatgtggaagtccaaacacacacacacacacacaaacacacacacactcctttttcacttatgtcattacactgaattcacaggtttgcattttactattttattttccttaacaaaacaatagtcaatatacgttctttaaagtttgtaaactgaatctcctacattattttcttagaggaaaccagttttaatatttctccatacttgattctagatgttttagtcagggagggctgccataaaagcatcatagatttttaaacaaactatatgtatttcttacagttctggaggctgggaagcccaagatcatggtggcagccaattcagttcctggctagggtcctcttccaggtgtgcagatggacatcttcctgttgctcacaaggcaaagtgagaaacctctgtcccttcatctccttataggggcactaatcataatgcaggctccacccttatgacctcatctaaacctaactacttcccaaaagtctcatttccaaataccatcgcactgtgggttaagactttcacatatgaatttcgaggtaacacaaactttcagtccttactaggttttcttttttttttttcttccctgtgtgtaagcattgtatttattatctcttgctatgtaacaaattacttcaaacttaatagcttaaaacgacatacattttttttatctcagtttctgtgagtcaggagtctgggcatagttcaggtaggtactcagctcaaggctgcgatcaaggtgtcggttagggctggggactcatctgaggctcaagatcctctgggaagctcatgtggttgttggcagaattcattttgttgcagctatagaactcataattgcttacttctttgaggctagcaaaagagaagatctcagaccaccaggccctcttttcctgtcctgattagatcaggcccccccagggtaatctcccttttgagaccctatcatttttgccatataatataaaggaatcagagaagtgataatctatcatattcacaggtcccactcatacttaaggaattatacagggagatggaatcatcttagtattctgcctatataccacaaggatggatggatggatagagagatagatagatacagtttttaaagattttaagtcaaaattatacatgaacacatttttcaacatcagttatttgtacaatactttacaaacaacattatgccatctctgacattcctccgatattgaaacacttttttttttttttaagacggagtctcactctatcacccaggctggagtgcagtggtgctatctcggctcactgcaagctccgcctcccggattcacgccattcttctgcctcagcctcctgagtagctgggactacaggcacccaccaccacacctggctaattttttgtatttttagtacagacggggtttcaccgtgttagacaggatggtttcgatcttctgacctcgtgatctgcctgcctcggcctcctaaagtgctgggattacaggcgtgagccaccgcgcccggctgattgaaacacttttaacactcttagcgaataagtttttactagcttatgtatccctaaatagaatgcccatattaccaatttataaactaacccatacattcataatatatactcttccttctagaagaatatttcactttctttgccctcactacacttcactaatatcaatattactacttcacttaacatccatcctttcttcccatcctcccaatgtagctataattgcttgtgtcaatgtttaatgcatacaatactatgacaatgtaaatatcttgagatgatccatgtactaaattgtgtttgcttttctttttctggacatctttcctctagtctctgtcccctagaataatttactagtcatttcatttgatggtctgtgtactcatagttcattcaaacacacacatattcaagttgactaaaatatctctcaggagtctcattcatattacggatcttgatcaatttaattttcctcgcaaaatttatctcaaaattttctgacctcctccaatgtgtccagtttcccctatgcctggtgccccagcactttgggaggccaaggcgggtggatcacttgaggccaggagttcaaaccagcttggccaacatggtgaaaccctgtctctcctaaaaatacaaaaattagctgggtgtggtggcacgcgcctgtagtcccagctactctggaggctgaggcagcagaatcgcttgaacccctgggaggtggaggttgcagtgagccgagattgcaccactgcactccagcctggcgacagagcgagactccatctcaaaaaataaaataaaataaaataaaataagccaggcatggtggcacatgtctgtaatcccagctacttgggaagctgaggtgggaggattgcttgaacctgggaggcagacgttgcagtgggccaagatcacaccactgcactccagcctgggcgagagagcaagactctgtctcaaaaaaaaaaaaagactcttactattgatgatacttaataatctggaattgtatttttaaatatattaaaacaatagatgtttcttatcttttataaagcatcctttcatgtgaaaaatgttttttaaaaaagaggcatgagcacccattcataaacagtatgtggtagtacagtaactactatttgcactttggtgtttatcatctcagatctctcaatatgtagaggaaatcatacattcctttaaccaatatttatctagttgctgccaagttccgggcactgttctaagccttggggataaaagaatactaaataggatatttaattgaatagaatcatttaactgaatagaattatttaatatttaacttaatataattcagttatatttatttactataatatcagttataatatttaactgaaataattaatatgtaattgaatataatatttaagtgaatagaattattttaattgtgcacacacacacatttacacatacatgtctttatatatatctctatatttgtaaaattgtatataacttaatgtgcatgcatatatacatagtacatataaatatatatatataacaggtatgtgtgcatagatataggaatatgtgcaaatattggtgcatatatttataaactaacacagtatatacataaacacaatgtgtgtaggtaattggaacgtcgtaaacactagtaaaattgagtatcttttcatttatttaataaacagctggagttcttcttttgtaaattgcctgtttaattcctttaccaattttgccgttggtttaaatacgacagaaacagaaagttttaaattttttagtcacaggacgcttacgcgcaaacacacatacaaaaaatcatcttcaactactctatgaggtcaaatgctaactgagtgaggaaagtagaagagggcgccagaatgtttctccattatgcaatgaatcccaagtaattctagacattctccaccaacttgggaacaagaagtatgggttgtcaggcttaccaggtatcctcatctggagctttttatgaagaagtaacagagaagaacaattgttatgtatgaggagaatcactagacttcaaggagttcagcatcctctgggagaacaaataaagagatgagcactccttccttcttccccaccaaccccaccaagagacctgagatgacggcaaaactctattaggggacaggccttggctataggtgtaacattttttggcctcttagtgtatgcctctgctctctaagcaggagatttggccttttttggctcggcgggatggctcccaatgcttcttcatttccctccttgctctaaggcaatggggtccagacttttgctgtgtatgagatcccccagcaagcacaaatgctgttataagttatctcctcaaattagcctattttatgagctgtgatgctgctatcacaaggagctcaggttctatggctccagaacaaggtgaattggcctgaaccatcttctgagggacaggggcaggaacaggagacaatgggcacaagccctgcactgggccctgaaagttttcctcaacggaagccccacccgacaacttcctgtgcccggacttctggcagctgttggctctgtccggcctcgccaacaacaggtttttacacttggatatcacctttgtcatattagcatcaagtctttgcccagagctcccggaataattcagagaagtcagggaagcccaatttcgggtcagggcctgttcaatctctccgctgaacgggcgtttctaaaccgaaagacctcacgggacggacgctgtaatggcgtagggtattttaaaactatttcctcacgatggcagtcgtgctccagatatgccaacaagtaccgctccctagtccttctcccgccctttctgtccaaaaaaacaccagcaagaaaaaggcgccaggaaacatggcagccttacttttgcccagtttgggacaatcttatcacgctgctgcactgttgcttttggtttccatttgaaacgaaactgaggccttctctttttaagaactgcatttccaataggtttagctttcacagttgtgttctcgctcactcagcatacatctccagtattttcccaagttatcacgttgtctgcttctggattcaagactcaagaatccaggcctaagcagaaaaagaaaatgctacaaactcaaggccgggaggttatctctaagtaccaaaccacatgtccttgcctggctcatccatctgtaaggctcccaaggaattctatattttcaggatagagatctaagtcttatgtgttgacttgttggcagccatttggctggagtcttaagagaagcgcccaagtagctcccattccaagagttttgtcttgtgatttcatttaccatttgaagacactttccgatgccattaagtggtctccaattgcttcctaccactttattggatatgtagggacatgtgtgtgtgtgtgtgtgtgtgtgtgtgtgtatttatctttatatctgtatttaccatttatctcttagagataagccttaaaaccacttcctcattagtaattaagacatgatgtttgccaaggattcagaaataaccatgcactgataaagagtaaagcgctgtcataaaattgattaagaccactgataactttttggatcatgtcctcttactcctttcaatacacacagagttttatatttatgttcatatgtgacaatgaatttatattaaaattggttgtttgtacatgatggtttgcctaggagattgccactcctgattctcagacagtttggccacattacataaaatttttgtcttcatgtttagtaatcaaaacactgcaaaaaaatgtttcttggctgggcgcagtggctcacgcctgtaatcctagcactttgggaggccgaggcgggctgattacctgaggtcgggagttcaagaccagcctggccaacatggtgaaatcccgtctctactaaaaatacaaaaaattagcccggtgcagtggcgcgcgcctgtaatcccagctactctggaggctgaggcagaagaaccacttgaacccaggaggccggaagttgccgtgagctgagatcacgccactgcactccagcctgggctacagaacgagacttcgtctcaaaaaacaaacaaacaaacaaacaaaaatgtttcttattgctccatttattatagtttaaatatggcatatataatatataatattgctatacatatatgtgcacatttatttcaccttaattataacttgacttatactgggcatagttttatacaaagtcttctgcaccaacttacataaattgcatgtttccatatatcaacatctattttccctagctggaaatttctttatacttgattgtacaaggaggtttctcttcgaaggaattataaaggtaacatctgctgttggaaatctgctcatattttaagaaattacaaagccaaaaataaatggtatctcaatgaaaactagaagaaataacttttaaaatgtctttgccatacattctcttatcttccctatccatatataatgtacattttttaacctaaaatcccagttaccttgtatgtcagacatgcttttctcaggacagtttgaggtctttggaaacatcattaactactccttggaatatgcaatatttttaaggttgcttctcatatttttgcatttcctaaaattaagcatacctgtttacaaaataaccagacacattagccttgtacaaagaagtgcagtgaggccacaagtaatgcccactgaagcagataaggatttttaaaatgtgggtgtcttgaatacacctgttttctgtgatcagttaaatatataaatatattaggtctcaaatagccaacaaatcaagttttcaccaacaatttcttctgcacatatttgttctgggttgactctcaaattacaaatatcttatcagcttcttgaaaaatctcttagaatacacaatctatgaagaacaaatggaaacactttatcacaaatcccacttttttgaggcatccactattagcagcttgatgagtatattggtttaaacattaaaaaaatgatatataactgttcaataagaactgatgttattcagtgaaataaatttaatctatatctcattaatatactccccacattcctcagcacaatgctaggcgcgcgcgcgcgcgcacacacacacacacacacacacacacacacacacacacacacttccatttcttttcttcaaatccatcctcattggtcccactacacatagaatttggtgccctgaattctcaattcaacactagaaaatgagtactctccaatatcattaacttttcttgaggaacaagatagttttttatggttaaatctcatagcattcttttactgttgatcaaaccgtaagaattatatgcatctggaaaaaaatcagtaagtggaacaaatatatagcagtaaagaaatgatactcttaagaagtttaatagatattccattgatgtttgttatattgcattctgctctttttattatataattgtacatgtgtgggcacatgtggacaggttgtcaggatttggtgactttttacttacatgatatatgaggaatatccttgcatgatacatgaggaatatccttgcaacttgagttgcttctttctatcatagttttctcaggtctcacatcacataagtctcatcatatgtcgtgaaatatgcttcagaaagctggattttctgttaagtaaaatttggaaatagaatttcagaatagagcctttaaatcttgcatgtgtgtagaagtgtgtatgttttaaagaaaaatacatcttgtaatatgttgttttcctaattatatattgagatgatgctggtttcttgatttttaaaaaacttgcaaatgtaagcttttctcattttcaacatttcaaggctttggacaagtgtaagttaaaacgtgaaggcaagtcattagaaacatcactgtagaaaattacacactgttagttgcttgactggggaactttccagataacttcctttctgcctatttgcttttctgaaccaataggtttatgtgttcaacttgaattaataacatatgtaattaagagagaaagaaagacttcatctttcatttctatttccttgctattagccaaccagaatggtttgattcccgttacaacatttcacattttcttccctaaatcagaggtgtggtcatctcccctattgaggacttggcgaatggatttcaatctttccaaaggcttaaaaagactacctactatagctgaacttactgtagttgaacttggacaatggatgttttgccccctccccaccgccatccttgcaaaagaaatctcagcgatcctctttgtcctctcctttctactttcctgtgggagtttggctgtgcgatcactttcaagaggtagtctctggacaaagggtatgctcatgtgaaaggttaaatgatttggcctgttgaccttcaaagaggtgtaccaattaacagtgcttctcacctggtaggaccttgtccaattctacaaatcattacacaaacactgacatcaatggattccttttcaaaggcttgctcggggttatgatgaagatttaagggcattatggaagaatacagtgaactgcaatttacttcagtactggtgaatttgagactgtgataatagaggtgccttattcctttgccatctttcctgctgagtggttttctttttaactacattttgaaacagcttttgatctgagctgactgtcaatgattgagtggtattgagagttggcaatagttataatctcccattcctggtcacggtgtcacgtttgaattcctgggactcagcaagttgctgctgctttaggcctctatccactctctgaccagatagtctcttaatgtaaaccaaaatgtgtgggaatacaaaattcctgaccctgaggaattctagggctggggctacctctctgtcactcacaattctaagttaagttatggtgcactgtctccacacatctggctttcctagtctagcatatggtcaagtcaaactgtgactcaacagcaggcagcctaacccatctgatgcagggtttctctcagtcacctgcttagctgaagtaggctgaaaaggtcagaggtcaccttacactttcataaggtatttgagaccattgagacatgctttctcaaatgttttcaaacccttcttggctcatgtcaacctataacatcctcaaggacagctagaccaaggcatgaatagcaggaaagtcaatttccccagggaccctatggtctttgtagtagttgctaaaaacttcctagtagatgttatagctccaccctgggcaagtagaattcaggtggtgaccatatgttacagcagtgcatgagaataacattcctttctcttctgtaagtggtcagccactgaatccatcactgatacacgagaaaactctcacatgcagtcaatcttacaaaatttttgccttttcttgctatgctatgggcaagtgtcctgagggtcctgatgtgctcagcttttagagggcttacaaggaatcttcattagaaaaaggctaagaagcaggcacagagaacaatacttgctaatctgaatgaacagttaggtcccaagtctcaatggcctcatcttccttaggggaaggccaatagctaaagaactcatttctgttcctttaatagagctaagagtaggtttctctaaataggtaggccttcacactgggccctagaaaaagtgctgcaaagccatggtagctgttacctcctggcttcagaaaatacttccaggtcttctggttgtgtatatctgcactcctattgatgttcaaggatttattggcttggccaagtgacacacactgccttctcctcaggtcttccttgctctaggcaatgggggcaccagacttttaggtatccttgagacccccagaaagcacgctggctgctgttagatatcatctggaatgagatgtttcatctgcaccctaacattgcttacaccttgtgccaaccccctacctcattgttcaaagggcatggccagaggatatgtggccagaagtccccccaaataggatctgagccatttgttttagccccaccctcactgggtagatatctaagccccaatacttcctatactccacctgcctagtagctgtcccttcagtcctccccctgaccccccacttatcagcttctcccccaggatcctgcctttgtccagagctcctggaaggcttcagatttaaagtgaaggggacctacttagggctagggtccactcaacctcacaaaaggcccaacatttctcagttgctaaaacttgggggggctctaacaactttgggtttgtgttttgtcaaactacatcctcttgatggcagtattgctctggaaaagctgattagccttgcctgggcaccccacccccagagcccttctcctctcacccattcaatctgaaaaaagctaccaagacaaaggagacaggaaacaaagctgccttgctattggccctgtttggggaaaatctgctctttcgaatttacttttgctcctggtttccctctgaactcagactgaagcctataccacccagtttcatcagccatactttgtttaaagaatcccatttccgatagcattaggagatatacctaatgctaaatgacgagttaatgggtgcagcacaccagcatggcacatgtatacatatgtaactaacctgctcattgtgcacatgtaccctaaaacttaaagtataataataataaaatttaaaaaaacaaaaaaatgcccatttccactctaccatagctttgtaggtctgctcttcttcattcaaccttgatccccaacaatttcccaagttatctgcttcagtgggaaattcttagggacctagggctaagaaagtgaagaaaataatggaaataacagcctagagaagaacaaatctaggcaccaggccatgtgacttgtttcactgccaggttccctgggagtcctccattttctgacctgggcactaggtcttgtgtattgagttgggggcagccatgtcagaaccctaataggagggtccagatagatctcaaggctgaattccatacaatatccctcttggggtgacacacacactccaaacttacaaaattccagtagaaaggaacatgattttgtcttatggttccatcattcaacattaaaacacaagcaagttcccatgcacatcattatttgacttttaatggcttcctatggctttattatatatgtgtgtgccactgcttaagcttaggaatcagtcttatggtgtttcctcataagtaattaagacatggtgcttgtaaagaatttagaaaataaccatgtgctgatcaagaacaaaagcactgtcataaaatcttgtattaaacactaatagccttttgcatatttactcccattatttcaacatgcacagaggtctatatttacggtaatacactacaataagcatatttaaattaaatttatatatgcatcatgttttagatgcaaacttttcactgctcattcctgggtaactgaaattgtcatgaaatatttgcaagacctggattttagataataaaatatttgcaatgagcttcttgattgactaattcattaaagaatgttaggttctcaatttttaaaaaatttatacacaggacataatacctataatgccaccactcaagtatcttaattttgatacctgccttacctaatcattagtatgctgactatatatatatatatatatacatgctaacattggaacaggcactatgtgcttatgcctcagaacattagggtttcttttgtttatatttttcaaaacttataccaaaattttatcttaaaattttatgtaaaatctataaagttgaaacgcatactcactctaacactgaccatgattatgcatgatatgcataatgcatatatatgtataagcattagatagataggtccaagttacctggttacaggcctagagggaaaagaaaatgattgcacctattatatatatatttacttctctttatttatttatttttattcagcctctgggagcatggactatccttttctttaaagacaattgaatgcaaactggatacagttttgcacaaattcttcaacaccaccttataccatttgcatacatgaatgacaatgtatatttgagtgcttggattttttttgtatcttactctagaagacctttctatttcaagaaattacaaaagttacacccactgttggcaccgtttagattttaagaaattataagtagaaagtaaacggtacttcaatcacaacaagaaatagccacttaaaaatatccttgccatacattcttatatcttcactttgcacaaataatatacacttaaaaaatgttcaaattctcttgtactttgaatgctaaaacaagttttcctcatttgtaacttgaatgctcttcaaatctcattaagtattctttagaataatgacaggttttaaaatcttgccacatgtttttgcatttctagaaataatcatgcttctttacaatgtacctgctataacagccatgtatggagaagtgaagcgaggtcacaggtaatgccacctccagcagacaagaacttttaaaatgtgggttcatcttcaatcctcttcactcggttttggttctcatctgtttgtgcgtggtcagctctcctagcaaaagtgctaacccttcttggtttggcgggctgatcccatttctcttcaaggtcctcctagctgcaagcaatttggttgcacctgggacctccagcaagcacatggcatccttttataagcaacctggtattgtctggttctctgcagtgactctgctaccacaaaggtcctaggccccagagcctgaaggcaccacgtgtcagcctttcccagactctcaggggcggggagagagacgaatacccacaggcccagtacttcgttggttggtggcttcctccagtcccgcccatactgggagaataccaagaccccaccctacaacttcctgggcctggacttcctgccagaggccgacttagtcttccctccccacgggccagttcctacacctggacctcactctgtccagagcttcaggtaggcctcaggaggtggaactaagatccagctcatggtccgagcctgctcagcctctaacagaatggaactttccaatataagccctctaagggatggggctttttccagaaatttcctcacgatggcagtgttgctcctggaattctatccaatactgcccccaagccctcttctcccgcccgtctggtatgaaaaaaaaatgtgaccaacagattaaggcaccaggaaatatggctgacttgagaaactcgctcatactattgtgattttgcttttggtttttcatctgaaatcaaactggcgcctaaacctacactctcatcaggggtcttttcagttcaagaactcaatttccacttacctagtcttcacagttctgctttttcttcacctaactttttctcatggtactaaattgtcttggtgtatcaggggtcaaacctcagggatccaggcctagagggaaaagcaaatggttgcatctaagggcttggagaagagcaaatccatgttgttcttgcctgactcacttcccaggtttcccgggagtcctactcaatttctggcctaggcactaggcctgtgtgttgagggagaagcagttgtctggaaccctaagctaagtgtctagatggttctcaagactgcgtgctatacagtgcccatttggaagggtacacaaactcaaatatgtataaattccagtcagaggagactgatacagtctcatagtcaaaataatttaaaatcggaacacaggcatgttcctatgttcttatatgactgtcaatggtttcctgtgactttagtgtgtatatgcttatcacttaggggtcaatcttatggtattttatcttacgtaattaagacatggtgcttgcaaaggatttgcaaaggattcagaaaagaaccatgtgctgaccaagagtaaagcactgtcataaacagtacctattagtaatactgataaacatctggattatgttttgtgaactaaaaagtgtctgagacaggtctcaatagtttcagaaatttattttgcaagtttaagtacacgcatgcctgggagataggtccatgcctttcttcaaagatgattttgagggcttcaatatttaaaggggaaagggcagatactggggaaaggggaagaaattttgaaaagatgtgggtagataagaggcaaagggtagcattcttttgagtctttgatcagcccttcataggcgagatgagggtagaggaatagtcacgtacacattcatctagctcagtgaatctgcattttttacataggataaaataaacacagggcagaggaagcaatcagacatgcatttgtctcaagtgagcggagggaagactttgagttctgtcttttgttccatacctgtgaggataagccaaaatttacattgtcagggtgaaattcaacagaactgtttcagggtaaaaatcttggggctcacaaggaatttcctagtgggcaaattgtgagggagatatgtagctttttgtttttgctttgttcaatcattgtagccatcttatttaggaataaaatgggaggcaggtttgcctgacgcagttcccagcttgacgtttccctttggcttagtgattttggggccctgagatttattttcctttcacagtttcaacatacacatgcaaactcatatactcatgcactcatttcaatatatacacataaacatttatatttcgtgtcatacacaatagtaagtttacattaaaatgaggtttatttgtatgttatggtttggagtatactttcacttctgtttcctgggcagtttgtcattatcatgaaaaatttgcaagacctgaatttttagtaaatgaaacattaaccaagagcttcttgattgctacattcaataacaatatggtctctgaagacatgttcacttcataaaacacttatttaacaactggaaatttaattcctatgatgtctcctctcaggtatcatgatttgaagagcttctaatctttattatgctaacatgtgtatactctaaaacaaatattgaatcacaagtataacatgcgtgcatcagaaaatataggatattccttccttctcaaaattttaacctacaattaaatctaaaatttcatcttattttatttatttattattatatttttagagactgggtctggcaagtctatgcaatcatggctcactgtagccttgacctccaggctcaagcaatcctcccacctcagcctctggagtagctaggaccacaggcacacaccaccacacccagctatttttttcttttttatatttttttgtagagaaggggtctccttatgttacccagactgatctctaacttgtaggctcaagcgatcttcccaattcagcctcccaaagtgctgggattataggcatgagccactgcacctggcctaatcttattttattactaaaaaaaattaacaacagattgcattactgtataaataaagtctgtgtcctcatctctttagcactgtgactgtgacccaaacacgtactccatcaaaggttcaaggtgaatgcattgacatatttttatattcatctataatcttttcttaatgtttccctttaaatttatttatttcctaaaaattaggtcttgcaaatttttcgtaatgacaaattgccaaggaaatagaagtgaaaatattatccaaatcatgatatatgaataaatcccatatgaatgtaaacttattattatatatgaagctaaatatcaaagtttctatgtgtatacatatacacatgtacacatatacatacatatacaaacacacattaatatacggacaaagagagtgaaatttaagtgcattgttactataataatcataattaaaaatatacactttttagggaggctgaggcaggagaatcgtttgaacctgggaggcagaggttgcagtgagccaagatcacaccactgcacgctagccctggagacagagtgagactccgtctcaaaaaatatatatactttttaaacataagtacacatatagatggatatggagtcatgcctaatttaatgacagggatacattctgagaagtgcattgttagttgatttcatcattgtgcaaacatcatagtgtacttacacaaatctagatagtatagcctactacactcctaggttgcagaatatagcccattgctcctaggctacaaagtggtatagcatgttgttatactgaatactgtaggcaatagtaacaatggtaagtatttgtgtatctaaacatagaaaaggtacaataaaaatacgatattataatattatgtatgacataaccatcatatatgcagtcagtcattgacctaaagatcattatacagggcatgactgtatactaatgtgtagtttatctatctttaaacataattgaatgaataccgaaggtagttttgaacagaaacatcatcattatctcatacaatttccatgttcccatatacatatatgtacttggagaacttgaaatctttttattctaccctggaaagagccttattatccagaaaatttaaaaagcaatagttgctgttggcaaactgttcagatattgagaaatcatgaagccaaaaataaatgatagttcaatcccaacaagaataaagacttttaaaatgtcattcacccagactgggcaacatggtgaaacctgtctctacaaaaaaatacaaaaattatcctggcaaggtggagtgtgtctgtagtcccagctacttgggaaactgaggtgcgaagatcacctgagcccagggaggtggagacttcactgagccaagatcgtgccatagcactccagccagggtgacagagcgggactctgtctccaaaataaataaaagaggccgggcatggtggctcacgcctgtaatcccagcaatttggaaggccgaggcgggcggatcatgaggtcaggagttgaagaccagcctcaccaacatggtgaaaccctgtctctactaaaaattcaaaaattagctggacgtggtggcacatgcctgtaatcccagctactcagaaggctgaggcaggagaatcgcttgaacccgggaggcagaggttgcagtgcgccaagatcgcgccattgcactccagcctgggtgacagagcaagactctgtctcaaaaataaataataaataaataaataaataaacaaaatgtcattctcatctcttatgtacatataataacattaaaaatcatattcaaattcctttgtaccttcagtgttcagatacattttctgtacatattgtagctagagtactttccaaacttcattaaatattctttgaaatactgattatattttagagagtagcctcttacttttgggatttcacaaatcagatgtatttctaaataatgtgttcaggtacaacatccatttttaaagaagcatagcaaaatcataggtaatgccacctcaagaggacaaggacctgcaaaatatggttgtattttcaaccatatttcacagatatatgttgtatacattcagagatatagattccttaggactctctcatgtgttcaacacagcaagttttcaccaataatttcttttgcacttttttttttttttttttttgagacagagtctcactctgttgcccaggctggagtgcaatggcgcgatgtcagctcactgcaacctccgcctcccaggttcaagtgattctcctgcctcagtctcccgagtagctgggattacaggcatgtgccaccacgtccggctaatttttgtatttttagtagagaaagggttttgtcatgttggccaggctggcctcaaacccctgatctcgggtgatccgcccacctcggcctcccaaagtgctaggattacagtcgtgagccactgcacacagccttctgcacatatttattctggatttgttattgaattacaaagataatagaagcattatgaaaaatttcatagagtgcacgaatcaatgaaagacctaaggaaatactttatcccaaatcaatctatcccaagggaaccactattagcagcttaatgggtacatgtattcaaatgttgtaaataaggtgtacaaccactcatgagagctgacattatttaactaaataaatatatcctactgcacatcaataaactcccctatttgctgacaagatgcttggagcatacatacattcatccagggaggaatataccatttattttcttcaattacattctagttaaaatgtaggtggagttttgtgtcattgtttcttcattcaacattgaataatggatactgaatagcatatctcttcatgatagtactttatttttaatctcatacgattgctttgttgttaagttcttaaggataatagatgcatctggcaaagaaatgacaaatgagtaatcgtaaaacaggaaagagaggatactctgaatcacacaaactcaattgatatttcaatctagtacattccaccttttcttctatatacacttttgcatgggagtgtacaggggttttttggtatgaatttaaatggacatgacctatatatggaattctctttttaatttatttttcttttttatgctttactcaggtcttttatagcgaggccacttacaatgccattaagcatgccaaagaagactggattttatgttaagtaattatttgccaaaagcttttctttccatgaccattaaaagtaggacattaatcatttcaatgtatatatagaagtgtgcctattcttatggaaaatagaatctgaaataaaacaatattgtataacttgtacctttattaaatgtatactaggaccttttttgggttttctgtaaatttcagaatcaacccttgctcgttttcaacatttcaatttttaagacataaatagttaaaacctgtagactctaacttgtatttttgagatacaaactatactagtgtttgattagaagccttccagaaactgtacttagtacatattcaccctctagaatccgtatatgtttatggttctgtgtaacagtagagaaaaacagtctttcataagagtaatcctcatgattttgttttacacattagtttcttagggataccaaaagcatagccaaccaaagaaaaaactcgacaaaccagatttcatcaagttttaaaaaagttgtttcacaaatgataccatcaagaaagaaagaaaaaactcacagaatgggagataatgttttccaatcatatatttggtaagggacttgtatccagaatataaaaaactcttaccactcagtcataaaaatataactcttttaaaaatggacaaatgatctgaatagatatttatccaaagaagatatgtatatggctaacagcatgtgaaaagatggtcaacctcattagctattagagaaatgcaaatgaaaaacacagtgaggtactacttcacagcccctaggttgtctatattttaaaaagacagataataacaagtgtcagtaaggatatgcataagctgcaagcttcatatatggcttgtggaaatatcacatggtacagtcactttagaagtagtctggcagttccccaaaagtttgaagattctatcatcatatgactaatcaattccaaacctatttatctacacaagagaaatgaaaacatgttcacacaaaaagtagaaacaacttaaatgtccatcaactgatgaatatatataaaaatgtggtatatccatacaatggactgttattcaaccatattgaagaatgaattattgatacattgtacaacatgaaaaatccctcaaaacatgctaagtgaaaaaaaccagacacaaaagaccatatcttgtaggattacaattatatatagtttccagaataggcaaatccatagacacagaaagtagattagtgtttgccagggactagaggaagctgagaatgagaactgctagtaggcatatttctttttggagtgatgaaaatattctaaaattgattatggtaatgattgcacaattctgtgaatatattgaaaaccaccacattgtacattttaaattggtggaatttatagtgtgtgaattctatctcaataaagctgtttttaaaagtttcaaaaattaacaggttaattcacatttataaaattaataagaaaaagcatataatcatctgaaattgtgtagaaaaagtatttgacaaacataaacaccaatcctgattttaaaaaactctcaccaaactagaaattgaagaaaatatatcttcaatatggtaaaaatatacaactaatgtcatacttaacactgaaaaagtcaacactgtttttaagacctagagcaacgtgaggaattcgtctctcacctcttctattcaacgtcataccagattttctaagaagtgcaattaggcaaaaaaaaaaaaaaaaaaaaaaaagaaaaaaagattacagtttggaaagaaagaagtaaaagtgctttcacagatgacagtattgtttacatagaatgattcttcaaaaacacttctaaagctgctaaagtccatatcttacagacaaggtatgattggtgttgcttttgtatctattcaaaaaaactgtgtcttttatgtggaatgtttaaccattaacagctaatgtatttactgataggttttaattttgggctacaattttatagtttacattgtttgtcctcattaatttgtattcttccatttcccctttccttcctttcaagtattagaacactttatcttttagaattctattataatatgtctgttggccttttggctataccactttgtgttattttttagtggttattcttgcgattgcaatatgcatccttaactttttataatcttctcagagttgatattttaccgcctcatacagaatgtaaaatccttataacaatatacatacttttactattcctcggtgtcctttatactattattgtcatatgtaatttatgtacatacattataaacacagcaaaatgatgttagaacttttgctttaagcattcaagtatattttaaaggaactaagtgaaaattttttttgtacattctcagacactgaacatttctgatgttctttactctggaacatgttctggctctggaagatctgtattttcccctgatgtagttttcttcaacctgaagaatgtcctatagcatttattttattgcatgcctaccagtgacaaagaatcttagttgtcttttgtctgaaaacatctatttcaccttcatctgtgaagatattttcaaggatggagaactctgggttgattttttttttcccatcagcactttcaagaggacgtgacactgtcttgtagcctccatagtcactgatgagaaagccatagcttttaaaataaaacatgtgatatatgacagctgcagcgcttcagttctgtgggggaaatgactgagttttcaatgagtggtcttgggattactgggcatccgtgcgtgcaaatgaaactttacttctccctcacagtgtacacaaaactcaattccatagtctcttttcaggtactcatggtgaggaaattcattataaacctgcacttgtgctatggaaagcccaggagaggagggagggctttgatggatttgagaggtgagaatgaatgtctagccaggggttggcaagctaactcacagaacagatgtggccagtgacttgtatttgtaaggcctgaaagctaagagtgatttttacatttttaaagctttgcttgaaaaaatggaggctatgtgaccgaggccacctgtggcttgcatagcttaaatcattcaccatcaggccttttacagaaagagtctgctattctctgcatctaggaccaaagataccttgacccatagtttctcctatgtagggacaggacatgttctagaaaccccactgtggtctaatgtgcacgtcctcttcatgaggatggcttcactgacataaacataagccggaccagattagcatttcatgtcaggccaggccccagaagcagagtagaatgagatccagacacaagttctaaccgtatctgcgacatggccttacaggaaaccagtggaaatcattcctcagtgaaaggcagaggcctaggaaatggggttggagccggggtgcgtgggtgggcatgaaggttcaccctttctggaggacctcccagaccacagaatcaagggggcacctcctggacatcttctcactactgtgtatcttccagtcttgatttcttaaaagacagtaaggtgaggggataaaggatcaggtgtgtgtgtc

SEQ ID NO: 667 - DNA, 36617 bp, Homo sapiens
gtgatggggcttaaattgtggaaggactttggaaagggagaaattacaatatatctgtatatttagattgtttgcaacaagaatacatatacacactgctatttttgtgatgagactctttaaataagaaaagcagcaaaaatagttgctgtgtattagtcagtaaaaataaccgctagttgatgcaacagacaaaccctaaaatttgaatggattgacacaagaaaagtttattttatgtgcccataagttctgatgcggtttggcaggggctctccactctcacatgacccagggatccaggctgcttccaccttgtgattccatcatctcaaaatgaaactgccatgtttactgttggatggaggaagaaaacttggaaatggcacactggttctcaaatgcttggatgtgacaaacaacacttctgctcatgtttcagtggtaacaagtggtcacatgacccttcctaactgcaagtgggctgtactgttcccatgtgtccgggaaggagacaaagacaaaatgtgagtgagtggtatagtctcccccataaactgttatgtaggaggtgctcaaaaaaagcaattatgataatttggtattacacaacccttgtcattgctagagtttctgagaagcccacatttgccttgaagttctctaacattttcaagtgcctgctacgtgactgatgctttgaaatgtaagatcacaactgtccaagaactttgaaagtctcagcaggaaggctcatcagggaatcttccctttataataccctttaaacaattagtaggctttgaacttttcctccatttgattcctggtcaaaattttaacctgtgagtttctgctacccttcacatgcctaaacacctgtcaggtgcctttagacacaatgaaagcacatattttcctgtggggcaagtactagacaagagaaagtagaaacttggttaattattctactaaaatttgagctagtactcccaccaaggcagcatttttcacctcctgggagactctggggttttagttcagcctcagtagatgttgactccacagtgatttccatgttctttcctcatctccagcttatgcgagagagtttagattttcaccaccaaggtaaggtcattcatccttgtatgtgttcagtgaccagtttcaaataaaacaccccattaaattcctattacgaataacaaaatggctttaaaaaactctctctctgtaacttcgtatctcaagaatagtatatcatgtgctaatcacattccactcaccatctatttagaaaagttcgagggtgtatttagacacacagttgggatgacaggatgtgtaaaggggaaggcaggtgattccgcttagccttcacagcaagcagcagggaggagcaggaagcaggccagattccaattggaagaaagggcacatgagggagaccaagggaaggcctctgtggcgcgagaaagtgttagggttggacagaaattcctgcacttgggtagagtcagctctcaggaaccctagggctcaggcaggaggaccctaggttaataaagcccacagactatccccagattatgtttcattctcattgtcaccttccttttgtaggcccgctttcagtaccacgtccacagtgtccttcttttggccacttgagagacattatgcagtactgagaaaacaaatgaattaagggacagaggtgtacttcaggctgcaaagagtgagaatagaatgggctctagatgaattcaggccaaccttgtggtttaccagtgatatgatcttgggaaagttaccaagcaccatgagactcaggttcatccagaaaatgggtttgatagaccatttttttaggactgttgtaatgtataaaatgtattaaaacacctgggatgatgcctggcatgtactggatatttaatgattgacagctatttctagtattactgtgaccccaggtgctaccactctctactttggaatattttttattgtccaggacatctcagagaatctgcaactcagtaggaaactgcatttccttggtgaatatgtatgtggggggaggggggtgtacatgtgtgtatgggtgtgtactttcatagaacaacagattaatatggataagaagacaagaattaatgaccttctccttttatttctctgtttcacaacaccagttcagctttattgttaagttcttacattctccaagaaaatacctattgcaaatcacagcaagatggaagatttcccaaaatgttttacaaaatggcaaacacttgcacttgaaatggataagcaaaacaacatgtgtggtcagtatcatccatacacttagatgttgaagctaactaaaacttttattacaggaacaatatttgaaaattaccaaaaggaaacaaaaagaaatctccaagtcacccgatggaagagaaacctaaaggcagtatacaatgtgttcccttccattcactgtgccttctactactgagaacactgacttctctcatcaaacacagagggaagaatgggcctgatttcacacaggacagggaaactgctgggtgtggccctgaagcatgcattggcccatttccctgcccgctggccctggttgcatctcatgctcagactccctctccctcctctctcaaagcatcttcatacagggatgggtaagaagtgggatccctcccattggcattggctatgtactcaagaactttcatcttgctggtctcagcgtgggcccttggaccccacaggaactcatagcatgcaggatcagtgccgggcacctgccggtacaccaggtacttttcctgcacccaattttgggtgaggagcctcttgggctccccaaagaggaagtgctcccttccagcatacacccccataatgctcaggacttcccacataacctcttcagggatgcagttcccctccatgaagattacacccaggactattatcaggaggccagacttgggcatgctctgctcattacactgtatgccatcataagagaggttgagggaggtgacaaggacataggagtggctagtggggtccacttccttcacatcaatgccaaagagcagttgcatgcatacagaggcttccctaaatatctcaggaaagtagtcctcataatttttgatgacactccccagcatttctgcctttgtgatcagccccttgactcgatacttgcggagcaataaatgaaccaaatcaattatcttgtcatgtagtatatcttgggaaaaggactcagggtctatcaggtcaggcgaggtacttggcccctccttttcttggctgccagagccctcatcagataggctcccaaagatggcatccatggcagtgggagagaaggactcttcctgaggactctggggaggacttggtgactcagcagcaggcaactcctctagagtgcccacattcagagtagaggagaagaaggcagcctcctgctcctcagcttggagagcctgtgcacccaccaggcccaggtcttcttcttgggcctgaaggccttcctcaggcttgcagtgctgacttctttgctcaagaggcatgatgactctggttaggtcagcaggccgaactgtgggaaatatctgggtgatggggccccacagcctggggagagagggagcgtgagaacagactcagatgagatatgaaccatggagaatctaacaaaagcctacttacacttgttctcctccagtgatcctctgggttctcctgggactcctgtcctccaggttggcctgttctctaaaaacctgaaaaaggaagtgagaaggctgctcaagatgcagctggacatcagagcaggaggctccaggactgaggtagggcaggtgaggttgcaagctgggggtccctttctgtactggggcaggtggggccatttgtagattaagggtgaacatctcatcttgactactggcactgcctaggcttcctgtgttctgagatctgaagacattgcttgagaccaaggcctcactgctcagtttttggagcttctagaagaggaatcatggggccatcaggctgcagactgcaagcacccatcctggcaccccagcactgtcagaaaggtgggccaaactctgtgagtttctcacttttttggagtggatggtcccctctgtgctcagggccctcacctttctcctgccagggcctggaagacacagctctcctgacctgagaaactctcagatcaatagctctttcctgatatgaaagaggacatgtggggatacacatctggccacatgtacacagggctacccaggaaggacagcaagagatggtgacagtcagcagggtccatgtgtcctcgggtaaggagcctgtttggttcccatcttgatgcctatcttggcctgggaccctccctctgttgacctgacgccatctccttaaaccaaagctctacctccaggagacatcagaagaggaaatcagggaaatagaaacacccatggtcccagggacttcccatagctgacagaaggggcagggaagggctgagtcccatgtttttggtaagtgctgtcccgtcagcccccaccttgattctggtcatggcctgggaccctcccactgctgacctaagtgcagccctctcagaccaatgtctcccgctccctgagaccaatgatcccagtataagagaggggtctcagcacatagtcctgcacatgctctctggggagacagcaggggcagagcagatttctaagcagccctctgtgttctggccaggaggaaccctcaatcctccctcaggtttctcacctggactcttggcagatcctgggaccactgtagttgtggaccatatggggctctttctgttgactggaagtcgtcctctgagaacatagtgctcacctgcccaagattccaaaacagaagtaaggggccccacgtcccatcaccccatcatgtggttgtccagggctgacagcagaggctggacccttcggttctggggattccaaagtcctcctgtgggtttttcatctttacttctgccagggcctgtccttccttgactcccaacccctgagatgagcagacatatccctttacaccaagacctcatctccctgaaggtttcccaactttctgcctgtggtacaagtgaccttgccacttggggccacccgtgatgaggtccccatacagccaaggacaggggacagagagactctgtgggatcccttcattatgggatgtgggtatctccagtcctcaccaaggggacacatacaccttgagtcctaaagatcctgggactcctccctctgctgatcaggtgtggctccacctgctgacctgtcatcacccccttgaaacaaggtgctcacctccctgagcaaggtgccacccccaacctcgtggcagaaatgtgagcatggcacatgcctccccaacttgggcctccgagggatgaaaacagaggaagcaaggattggtgaggtccctttttctttggcatgtgggagggtacattcttaccttcagtcttcatcaattttcctctccttgactactggcagatcctggactccaccctgtgctgaccaggtgtgtatccctctgctgacctgaggacctgcctcagaccaagggccccacctctctgagatatgggaggcagaaagtgaaggggcactacatggacacccctcatgggatgccaaaggctgacagatgaagcagatttcaggggtgcctcctctctctgggtttcctccaggtattcagatttactcctgacaaggcctatccatgtctctcctgctgaactgtggatgagttttgcaggccacgaccaccatctcccagagaaccccaactaggaagtggggagctgcctctctttcctagagtcctgcttggggcctccaaggaccgatggcaggggcaggttttctacctcagggataattggttgcctgagtcctccctctgggactcctccctgggttgacctgaggctccactcctcagaccacaacccactccttgctgacaccccaaaggcagagtgaggatgcaccacatgtggccactgtgccttggaactccaagggccaaggtccctactgacctggagtccaaagtctcctgagtcctccctcttcttcttcctcttgatgctggcagggctgcaccccagaccccctctgcggaactgagtctccatccctcagattcccaaggctgaatgaaaaggcacctcagtttgagacggcgggactatgggggggggctgttctggggtgctgggtcccttcagttgtccctcaggccttgctcacctcccagcagggactgagccctgtctgtgctccccctaggtctttctcatgataccaagccccttccctctgtcagcccaggatgcggaaatcaggatccacttgcctggcagcaatgccaggaacttcccaggactgacagcagagagggagccttgctctgtggggcctcagccctccctcggggtcctgaccttgatgcctggcagaacctgggtcctgccccccccaaccagccctgccctggtcacaccaagctctgaccccacagtcccctgaggcttaagcggcggggggcagaagccgaggggggtgtcagaggggacggcccagcctgagaagtccatccccatggggtgatccagggctggcagcagaggcggtgctggattatctggggtcctctatctgggtagggagcatcctcagtcctccctcagcatctcatcttgcctcctcacagagcctgggcccgctgccctcagcaggtcacaagccgcccttcagaaccgggctatcacttctctctgaccccctaatgtgcaactccgcagtaccaagcccggaggtcctttgcgttgtctgcagggacaaggatggactttgtggcccctctatcaggatggggtggaacctctccataatttctcagagtcctgatgttgatgcctggaaaggccggggccccaccctttatggaactgcctctgcccgggtcacaccatagactcgcagagtctccttgggcattgaggagggggattgtctcagcctgataatttggtcccctgttgtttcagggctggctccagggttggcgctggattatttggggccctctatctgggtaggaggactcctcagtcctccctcagctctcaccttgcctcctcatggagcctggacccgctgccctctgccactctcaagacacccctcagaaagacgctttcgcttctctcagatcccagaggcggaagccaatggaggtcacatccggcccccacgcctggagcttccctggatttacagcaggagcgaacccgattctgcccgtgtgggggcggggcgaggcgaggcggggcggggcgaggcgaggcggggcggggcggggtggggcagggggaaaagtagtggcgaggggtgcagatgtggtcgagggtcatgggggtgcctcagtcctccctcaggtttctgaccttgattccttgcagagcctggagctccgtcctctgccaatgatgtctgctcctctcggaccaagtctctgactctgagtcccctgaggtggcagtgagcgggaggtgtgaggtcgggggacaacattgccaaggtcttccggggctgacaggagggaccgagctggattctgtggcccctctatgtggggagggtggaccgtcagtcctcactcaggagggtcctcctcttggctactggttctttcatgaagtgatgggtgggagatgctctgtttctgtcacctctgagcattgcccaactgcaccccttgcagacaatagctgcggatcccaggctaggtgcttccatgtggcttcagtacccgtgattgtagtgacctctgggagaagatgcacaccttcctacgggggctcctccccagccagatctagactttgcaaacttttgccctgaaagctttatttttacactgaagaggctgagtggctgcaagaaatttgcggaagtcctgcgtttagaatttatctaacacttcatagttcattttagtgattttcattttttaattctcattcagtgtcaaaaatcatacttaacctaactgcctatttcactctaatggtcaatactctaatttaatccattctttatcttcaattaaaacgataatttttaaaaagccaatctttatctactgacgtggttttagtggttatcagcacaaattccagccgtattcctttaatcaaccagtgtttcctcatgtcctgaagttaccccatgactactggcacctgtggtctgagaccctacccgagttttccacagtgaagtaggggcagaattttaaacatttctttcttcctatccaccccaacttccctgccactcttcccccccaatcacaagtattccttcaaaatacaatgaaattctcagggctctctcatgttttttttgtttagatttcttttttgatattgtttgcttgttcctttatttatttatttttattctttagttttcccgggttgttttggggagtctaagatagaagcccaagactgaacgcggtggttcacacctgtaatccaaacactttggtaggccaaggcaggaggatcacttgagcccagtagctcaagattaatctgaactacataacaagaccccatctcaaaaaaaaaagaaagaaagaaaaagaaaaagaaaaaagaaatgaaaaattagctgggtgtggtggcgtgtgactgcagtcccagctggtagggaggctaaggtgggaggatcactggagcccaggatgtcagtgctgcagtgagctgtgttcacaccactgcactccagccttggaaatagagtgaggtcctgtctcaaaaaaacaaaaccaaaccaaacaatcaaaaaccaacagatgcctgagcttgacagtcatcttggctggttaaggaattacgtctgtcaatttttgaaaaaatagaattgccatctttgcaatattctgttccctatcaatgatatcatatactgccttgtttatttgggtgctctttgaactggatatatcagtacttgtatagttgcctcagtaaaaatcatacatgcttttgttagtcttcttgttaggtaatttttggatattgttgctattgtgaatggggtattttctatgacctgttcttaatagttattgtctgttttgcaaatcttttgattttgctttattgatcttctgttcgctatttttcacatgtctcttattcatttgactatttcaagtgtgcatttttttgaattttctagatagactgttgcattaccctaccaaatatcactctttctttccaatatacatacctcttatttattttggtatccatatctgtggctttgtattccaatacaactttgaaaaatagcaatgatagcatacatttatgacctgtgcctgacatgaatgcgtccaacattttacaattaagtatatttgctatcaatttgatgaaacaaaatttccttctactcttaattttctagttatttttatcatggatgattactaattttttcaaaatatttttctgtatccattaatatgatcatatgttttgcctctataatcttgttaatatagggaatcacactgaaggtatattttaatgtcaaattgtattttcattctttggatatatcccgtttttccatttagtacactgccctaatgaattggctattaatttatttaggatatttgttgctatgtgagtaactttggtttaagtgttcttttcatggtgaggtcctcttctggtatttgaaacaaagaacactagtctcagaaaatgagttccacagttgcccatctttttgtatggtttttaagagtttgcttaggatggcaatgagttctaattatttggtaaaactggcctctgaaactttcttttcctggatcatttgtgggtggcttgaactgagaatacagttttagtttgtaatgtttgattaaagttttctgtttctttatggaccaatttgatctttttttttttttttcgagacagagtctcgctcagtcgcccaggctggagtgcaatggcacaatctcagctcactgcaacctcctcctcccaggttcaagcaattctcctgcctcagcctcctgagtagctaggatttcaggtgtgcgctaccacacccggctaatttttgtatttttagtagagacggggtttcaccatattgtccagacgggtctcgaactcctgacctcgtgatccacctgtctcggccttccaaagtgctgggattgcaggcgtgagccactgcgccgggccattttttttttttataaaatatagttcatttcacttaggatttcaaatttaatggcatgatattatgatgaaataactttattaaagtgtcagacatgtaaaatagtatagtataatatacccaatatacttgatattcagcatcaaaaatcttcaatccattactaatctgtttccaactatacttctacctaccccacgtctcaaatgctggaataatgtaaaccaactcagtaaccttggatagaatactggatccaataagccagttcatggtacagtgcagctgacctggctctgagacagcctatggctcagagaaaagggtctggcttcaatagaccagcctccctagacccctacctcctactctctgttccagggtcctgaggtactgcacgcctttgttctcttctagacacatgctcctataatactgctagctaatactgctttccagacacccttgggtctctctccaaatatcttctctgtgaggccttctatgaataacctttctttttcttcatagaatttgtgtctttattatttatttttgtaatttcactttcattttagattcagggggtacgtgtgcaactttgttacatgggtatattgtgagatgctgagatttgtgatattattgatcccgtcactcaagtagtgagcatagtacccaatagttggatcctgacctttcatcatatacaaaaattaattcgacatggattaaagattgaaatgtaagacctcaaactataagaatcctagaagaaaacctaggaaacaccattctggatatcaccctcgggaaataatttatgactatgttctcaaaagctattgcaactaaaacaaaaattgacaagttaacctaattaaactcaaaagcttctgctcagcaaaagaaactatccacagagtaagcagacaacctgcagaatggaagaaaatattccccaactacccatctgacaaaggtctaatattcagaatctataaggtgcttaaacaattgaacaaacaaaaacaaataacctcattaaaaagtgaataccctttctaaaattgcaatcctccctcttaactcatcccaaacacttattcagttctctagattcaatttgtttccatagtatttatcaccatgtcaaccaaaattaagactggttaggcaaaaataagaggataaatgtttattggaagccaaatgtgaggactgacctgggaggagaaaccaacaaagttgggagtgttctggagagtcttacaagttggaagggttttatgagagtttagaacaagagagaactttttatatggcagttgtcgttttttattagaggatacaatacggaggttagaatcattgtaccaaattgcaacatacagactaaaatgtccatgtgcaaaacaaccagtaaaatttcatgatttaaaaataaatcagcaaacttttcaatgttggtacattacatattaatccatatgtaaacaatttgtggaatgcaggataagacactttactgagggacaggatggcaacagaaatcacaagacctcccccaggtgagttcatttggaagcctaccaaaggtgatttggaagttaaccattaaatctactgcacctttaagtttgtttcatgatttattgtgtgcctaccctttacctcactagaatgtaagttccacctagggaggaaatgtgttcaatattgtatcctcagagcccaggacagtgcctggcacacaatacatgctcagtattcatttatggaatgaataaagaactgccagttctatggtcctagtatttggagcttctctggtactaaagtctcatggaattttcaatctttccaaacacccaacagccaaagtttgaatgctcccactatcttctaattgttggctcctggaccaggtaagcatctgagttttaaagggactccaaaggcctgctttcccagcttctggtttgtgctcctcacatcctgggtaagtgagcatggcagggctctagccacccagggctatctgaacactctctcttgtcaggaggcagctgtgacctttccctgatgccctgtttctttttccatcttgtttggatatgcaagttaacacagtagtccttgcaaggtggaatctaacagcctaattgtacctgttgggatttggggtttccttctcctgaggcccatctctgagcccccatcaccttggctgcagtgcccacacttgcccacagtttcccgtatctgacttcagtcttcccaactggggcttggaattgcagctctccaatacaactactcaagactcagtgctgaggcttatgaacagttaaacttttatttaaaattctctacttagaaatccccttccaaagtattatggttcagatagaactggcagaagatgaggtagccatttggtgagtttcctaggggttggtaaataataaaagaatgctgtgtgaatgagtgacaaatcactataatgatgacttacttttcaaatgatcccctatgtaatgcccacacattaattaaactaatcacctcgttaaggcgcctatgagtttttgctttctaaacttgatccagagaggtgatgccgaactgttttgtcagctacccaaagagccatctaggatctcggtgtacccccaaaaagtttaagaagactaatgggtgaaacccactgtgaggtctgtggtcattagtatactcctccaggtcccagaatatcctcaggtcaaattaggatttggaaaggagccaggaagggtaaggctttcttgttaccaaagggcataggctgtgatgagtttggaaaagtgtgagaaggatcacctgctggatccatctatagtgccttaggctggccacgggaggaatgtagaagtaaaatgggactggaggtgagctggagccctgcaagatgtcatgaaccgagtgcttccagaaagaactccagagcagactgctttgtcgcactccaggatgacaactgtgacacttagtgccctttgttggagagaaacgacggatggggagaatgctaactctaggatgcctaagtgttgcagggctagagcagctagggggtctcacagcaccccaccaacagcctcttctggaggcatttccagggtctagcatatcccacagcagcctcctgtgtggttacacaccacagaggatggaggcaatcctgaccagggtagggcagagcagatgggggccttcctgtgcccatacatgggaaggtcctgactgtctctagatgtcctgagcctgcccactgagggactgatgtgaggcctgtcagccatggtcctgctctcctaagagacctctctgttccaccagctatgactgaaaccctgcacttaacttcagcttccttggcaaggggctgacctcctgcatgcttcttgaaagctgtattagtccattttcatgctgctgataaggacttacccaagacctggcaatttaaaaaagaaaggggtttaattggacttacagttccacatggctagggaggcctcacaatgatggcggaaggcaaaaaggagcaagtcacatcttacgtggatgacggcaggcaaagagagcttgtgcagggcaactctcattttttaaaaaccatgagatctcgtgagactcattcactatcacgagaacagcatagggtaactgcccccatgattcaattatctcaaaccgtgtccctctcacgacacatgggaattatgggaattatgggagtacaattcagaaggagatttgtgtggggacacagagccaaaccatatcaccagctcttccctgtgccaattaccctgtcagcttttcctgagcaaataaggagtcctgggtctccttttatccttgatcccagggctggagctgaacatagggatagcgggggctagtggcaggatgcttgttatgtcccaagggaaatccacaaaatagcatcagaggacaaagccaaggttgcccatcactcagactgagggtcagtgcaaacaagccctgcagacactgacacctacgtggatgcagtgagagtccacatgtctcatgagcactgcgctccgtcctacttgccccaccatgtatctggttgccagcctgctcagtggagttggctcgaaggaaattgttgagtcatctaatctgctgagaataaaagagaccaggccaggcaggtacacagcaaggcagggcacatgtctggacataatagcagcctctggaagactggacttctgatatccatgtcaaatggttgctgtagcttagcctgggcaactgcacttgggccatgagctgccagggtaccctaaaggtcaatggaagtcttcctggaggctggacttcctggcatatatttgaggttctaagcctgcttcaggctccaccatcttctcacttgatttatctctgggatccctttgttttatttgtgtgtaatgcattttatcttgctgtgttacgtacttctttgtagcctgctccaaatattttctgaatgaagcaggagtgaaaaaaagggggaggaaaatagtgagcgaagtcccttctcaatcccacttaactctttaatgtcttcacctcatctgcattcccctctggatccccagtgttctgttaatggagcacaagctcattgcaggggtcgcggttctgaactgcagcccatctggagctctcaatgcagaaacttgtccatcttcacaccctttatcctaggacccacctctcctccacagcatttgtctccatgtcatatggatagaacaggagagaggccattgggtaggattctgtttcaagctttcactggcaccaccacttggctcctttaagatcagtcctaggggcatattgatagggcaatagttagcagtggaagatggctggcactcccttgtttgtgggttgcagctcaacccagtacagagacagggctttgaacccataagaaagtaagtttgaatattagctctgtcgcttataagcccatacatcaagtatcctttatgtacttcagttttttcatctgtaaaatgggagtaataatagtacaacttcagagtgtttatgtgagcatcatataacatgccacttgtatgtaaaatgtttggccctaataatgtggtcattaataagtggctattattattgtgtgcccatgatgtaccttcccccatattttaatattcctgaacctgtatatgtcttatgatccacatgtgcattaattaacgcatttattttcttttccccttgaaaatctgttaccttggattgtttaatcccacatctttgagctgtatagacatgatataacttgttctagtcctgcttggggcaataaccagggctattgaaccaggacctagatcaacacataggtctgtgagagttgctttgaagaattcctccaggctcaccctccctgcatccaatctcacaccccagagctctgcaagggagagtcctccaggtgaacacactgaatgccaaagaaaaggtcccacactgtgcctgaccctggctgcccaggttcacatctctgaggagtactagagccacattccaaattctccacaccactgcttgcacttcattgggatggctcaatggttattttaaaaagtacattgttccttgcacaaatgtttttgtattttgaaaaagcctagagttacctactttccaagtataaatctctttttgtgcctaacatgttgtcaattttcttttctccctatcttaaatttaaaggagcagataaaggcaatcttatgtgcccagaaagaagagaaccaaatatttgtgaccagccctgatatgcacaactgaggtcattttagaggaggaagctgaggccccttttctccatctgcttgtcattgctctagtctaggcctgctcttatcctgtgggaatcctcaaccctggacattccagcctcttaacagttactgtatgacaatagcaacacaaagaagtagggagagaatggaactgtatgtgaacaaacccattgtatactattttaattaagttggtattaatttaaatagattggtacaagttaaactatcaattgtagtccccaggacaactgctaagaaaataataccttaaatggcaatgggattaaaatggtagactagaaaaacatatatttttcacaaaggaaggtagcattgaaaatataaagaaggaaaaatacatatgtaatataaagagtaaatcactgactacaacacagaaatattaccttaccagtaatcttaaatgtaaatggattaatcacctcgattaaagtcagagattggggaaatatattttggaatcctgttctaactatatactgattatttataagagatttatatagatgtatacatctaaatacataaataggatgaaagtaagtatatgggaaaagatatatcatacaagcagtaaccaaaagagagctggaatggctatgctaataccagacaaaatagactttaaaataaaagttgttactagagaaaaagaaagatattttataatgatgataaaagttttagtctatcaaaaatatgaaacattataaacatatatgtacctaataacacagaccccaaaatatagaaagaaagaattaaagagagaaataaataattcaacaataattattggagactttaaaccctaatttcaataaaggtataacaagatagaaggtcgccatgactatagaatatttcaacaacaatataaaccagccagacctaacccccaattatagaacacagcacccaaaacagcggaatatttttctcaagtatacatggatcacctttcaggataaacaatatgtaagcccacaaaacaagtctcaataaatataaggggattgagattgtacaaagtactttatctgtctgcaatggaataaaatatgaaattaacatcatgctacctgacttcaaactatactacaaggctacggtaaccaaaacagcatggtactggtaccaaaacagagatatagatcaatggaacagaacagagccctcagaaataacgccgcatatctacaactatctcatcttggacaaacctgagaaaaacaagcaatggggaaaggattccctatttaataaatggtgctgggaaaactggctagccatatgtagaaggctgaaactggatcccttccttacaccttatacaaaaattaattcaagatggattaaagacttaaacgttagacctaaaaccataaaaaccctagaagaaaacctaggcattaccattcaggacataggcatggacaaggacttcatgtctaaaacaccaaaagcaatggcaacaaaagacgaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaacttaaacaaatttacaagaaaaaaacaaacaaccccatcaaaaagtgggtgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaacctagttcaacccttgtggaagtcagtgtggcgattcctcagggatctggaactagaaataccatctgacccagccatcccattactgggtatatacccaaaagactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtcaggggaggggggagggatagctttaggagatatatctaatgctaaatgactagttaatgggtgaagcacaccagcatggcacatgtatacatatgtaactaacctgcacaatgtgcacatgtaccctaaaacttaaagtacaataaaaaaaaagttaacatatttaaatttccaaaaaaaaaaagaaattaataacgttggtaaatttcagatattcacaaatttgtgaaaattaaactacatactcctaaacaaccaacgggcaaaagaaaaaatcacaaaggaaattcgaaaatattttgagataaatgataatgaagatatatatacacacatggtcatgtacaaatgaacaccagctcatcgcatagttcaagtgcactagcttgcattgttgattgcacagttttagagagacatgttgatgaccctattttgccacttccagagaccagatgtactgtgcaattaaccagaaaacactgatttataaagcatgaaaataagaatctcttctgagcttataactaaacatatctaaactataataaacattaaattccaaggacttgatatggtttggatctgcatccccacccaaatctcatttcgaattgtaatccctacatgtcaggggaaggaccatgtgggatgtcatcagatcatgggggagggtccccccatgctgttctcaagatagtgagtgagttctcatgagagcagatggttttaaagtgtagcacttcctcatttgcgcaaaccctccatcctgcagccttatgaagaaggtgcctgcttccccttagtcttccaccatgattgaaagtttcctgaggccttctagccatgcttcctgttaggcctgcaaaactgtgagtcaattaaacttttttcctttataattactcagtttcaggtaatattctttatagtggtgtgagaatggactaatacaggactacagctgtgcctgaacaggttacatcaaaaataataataaaaaaactactccaaaagatgaacaatggctacctctgccaaatggaagagtttagatgggctgccttctcaagttgggaacacaatcctgtacatacgtgcttaccagtgccacaccatagatttacaagtcagcatgggtaacccaatcagagactataaaatacccctcaataaatactttgttgcacagcttcaataagtgtgcttatctgacagcctaatatctctttcagggactaactttacagctgaagtcacaatcttctaggggtggccaccaatcaatgattaggcaatgcagttttagtcaagaacatacacttctcagaaaggccaccagccaatgactgagcaagtcgagggtaaaatggcttagaaagtcccataaaagggacccctcctccaagcaatctttgcttcagagctccaaattggactagcaaagactttgtgagatctccccaaaagacaagagggagaaattgggtatgtgcaattgttaagtacttacatgacatgcgaaataatatattatttgaaggtagattgtgattaagtagagattacattgtaaactttagggcaaccacaaaaaattcactaaaagagatatacataattaggcaacaatgaagataaaatggaataatagaaaaatgagtgcctattcacaatagcaaagacatggaatcaacccaaatgcccatcaatgatagactatataaataaaatgtggtacatgtacaccatggaatactattcagccataaaaaggaatgagataatgtcctttgcagtgacatgaatagagctgcaagccattatcctcagcaaactaatgcaggaacaggaaaccaaacatcacatgttgtcactcatacgtgggagctaaacagtgaaaacacagggaggggaacaacatacaatggggcctgtcggtggtgcaagggaaagagagcaacaggaaaaatagctaatgcatgctgagtttaatacccagaaagctgggtggcagcctgagggccatcaactcatgcatttaatcagaacaaagaggtacgcatcaagcctggaacaaagaaatatattgtctcacaagacaataagcccagcacaggctgtgagggctctttatctcccaagaagaaaatgttccaggtacaaggcccatcttatgcagctgagcaggttggtcaacagacaggacatgactgcctttaccaacaatattaaaaggagaatgtatcattattgagatttgtctcagaaattcaatattcacaaatcaatctctgtaattaactgtatcaacagactaaaggaaaatgcatttgatcatattcaaatgattaaaaaatttttatgataaaaagtctagacaagtcgaattaaaaaagaaataattcaacttgatataggacatgaaaaaaaaaagaaaacctctacagttaacatcatacttaatgatggactggataaaaagctgggatgtcaattctgaccaatcctaccaacatctctgtgaaagtccagaccaatgtaataaagcaagaacaagatattaaagacatactgacaggaaaagaaaaaaatgaaaccatctctatctgcagatgacattgattgtatttgtcccttttcacactgttataaaaaaatacccaagactgagtaatttagacaggaaagaggtttaattgattaatagttccacgtggctgaggaggactcagaaaacttacaatcatggcagaaggggaagcaaacatgtccgtcttcacaaggtggcaggaaagaaaagtgcagtgcgaagggggaagagccccttataaaacaatcagatcttgtgaaaactcagtcagtatcatgagaacagcatgcacctgcaggcccaataccacctggaaaccaccaaggcttggggcttgcactttctgaagcaatggcctgagcagtacattggccccttttagccatggctgggatgcagggcaccaagttttgagattgcacaaagcagcaaggccctgggcctggcacacaaaaccatttttttttccttaggcctcaagccagccaggagtcctgaattcctagccttcccacccctaggaaccccctacccctggtaggggcgaaagcatctgatgtcaaaaagactcaagggcatcatggaccttccatatgggtacaggactgcaggacgtccatcagcctcgaaaagacctctccactgcctttcagttgctagcttctcagactcataggcccaggcgaattacaatggggctgccgctggcctgggaagagcaaaaactgtggggccttgcacgtagcaggaaaagactggaaggagactcaagaccatgacaactcctttctgtgaggagccctgagagggtgaatcggtaatgatggagggtgccaagtgagaagaatgtaatgaagggatggttgtgaaatttgaggagagaggcggtgaggtcagggaagagatgtggggtcctcaggagggtgttgaatagggagagggcacagggtcaaggggtgtggtgcttggggtctgcagaggatgtggggtcaggaaagggtcttaggatttcaggtgtggggacacacagtgaggtcccaggagtggggcccattgaagtggaggctctgttctatctgcagtcttggtccacactccttaagattaaccagagaaacacgtagaggacaacaagatagtgaatatggacagagcagtgaagatgccagtggccacggaaaatactatttcttccatgctgtctccagggagtgcttgctgcagtgtttgatggaaggtacagcagtaggagtggtgtcagcttcgacctgcccgagcagagggacagtacttgaaggaaatgctagggccagaagccatgtaaaagcttccaaatgcacgtgtgtcagggccagcagtggcaggaggagccagcaacccagaccctatgactccttctgcggggatcagtcagatggccttggcattggtcagacaggaagtgaggtgggttaggactgagaactaccaggagtcagcagggcaccaccagcttggatcctgagtctggaagaagacctatacctgaagcagtgcccctcctccctcggatttgccccaggtcatccctaggaggccatcccattcttctcctgccatctcaggaaagtacatcacagtggagggcataagccagaccagcacccccaaccaaccatcatcccatgcgtgactttacacacagatactttcctacacacaaagaccaattcaaagctgcttgtcaccatctcttaagtgaatctttaagaagcctaatgtggcagggcttcaggtcagggccacttgatcaaacccagcaccttctgaatgaccaccagggcacaccgagaatctgcctggaggaagcccaagccctgccctgactgctttttctctacttcacctttctctcctcttccaggaaataaatttgcttatgctgagggtcagttgtcaccagtctgacttatttcttccactctgtcctacaacagtgcttctggactccaggcaatgctcctccaaccgcatcacctgggggctagttaggaaccagcatctcaggccccactcagccctaagcagtgagaacctacatatcaacaagattcacaggagactcctgtgcatgtccccatgtgctaatccagacgtggtgtttcttctttgtgcctctgcctcagggagtctgtgactcactgaattcagggtcctctgttcattagtcaggtggaatcaggcaggatgtcctgactggatccttttcagaatcttccgccaacaaaatcataccacatagcaagagctgctttccactttctgaagtggatgcacttttttgcaatttaacattcccagcaacaatgtatgagggctctaatttctctaccaccttgtcaacacattattgtcatttttattgcagccattgtagttagtatgaaatagtatctcatttaggttttgactcgcatttccctagtgactaacgaagttgagcatcctttcatgttcttttggccatttgtagatattctttagggaaatttctgttcatattctttgctcatttttaatggtttgtcattatatggtggtattgtaaatgttccttatgtattctggatacaactttcttatctgatacatagcttgcaactgttttctctcaatctgtgggttgtctctctgtctagaggtgccttttagagcacaaaaaggttttttgttttttttttgtttttagtttgaggaaatctagtttatcaatttgtgtttttgtgggggaaaactatgctataaattggagggaaaaatgcaacctagccacagtatgagctcaaggaagacattttttgaaagttgaaattgtcacattatttttaggtgtcaacgatccagtaaagagcaaggattagctaataaaagagaaaaaatgagacaatttcaagagaaaaatgcttgagaaagagtccattctaggctcttagatagtgctggaatgctttgtcttttgtcagaaaagaaatgacagagaatgcaggcatattggtggcatcagaggcgagataaagagtgaactgccatcaaatagctttcgtttgccttatcagaaaggtggaaaattggccgggtgtggtggctcatgcctgtaatctcaacatttggaaatccaaggtgggcagatcacctgaggtcaggagttcgagaccagcctggttaacatggtgaaaccccatccctactaaaatacaaaaggtagccgggtgtgatgacaggtgcctgtaatcccacctactcgggaggctgaggcaggagaatcacttgaacctgggaggcagaggttccaatgagccaagatcatgccattgcactccagcctgggcaacaagggtgacactttgtcgaaataaaattaaaaaaaagaaaagaaaagaaagaaagagaaagaaaagaaataaagagaaaagaaagaaagaaaaaggaaaatcatcagatactgttgaaggctggagtgttttggagatttgagaagattcgaaatagattttttgcagagtgagaaagtgaattcactagaggaattgagcaagttgtctcaaatacttcaaaggacatcatcaaaaaattgaaaaggcaactcacagaatgggagaaaacatatgttaatcatagggataaggatctaatatccagaatattaagagaacagtcacattttaacaattaaaacacataaccccatttaaaatgagcaaaggatttgaatagacagttctccaaagaagatacataaatgcccaataagcacatgaaaaggtgctcaacatcgttagtcatcagggaaacacaaatcaaaatcacaatgagataccactttacatacactagaatggcaaaaataaaaatgacagacaataatagtatctctaaggatatacagaaattagaatcctcatacactactgctagaaatgtaaaatgatgcacctgctatgaaaaacattttggaagatcctcagaaagttaagaatggagtgttaccttatgacccagccattccattcctagtcctacacccaaaataattgaaagcaaataatcaaacacttgtacatgaatgcacatagacgcattattcataataccaaaaagtggaaataacctaaatgtccatcaagagatgaatgtataagcaaaatgtatatacatacaatgaaatgtcattcatccttaaaaaaatgaagtgctgatacacgctatcacatgaatgaagtttaaaaataatatggtaagtgaaagaagacaaacacacacaaaaagctacatgttgtatgattacattattatgaagttcccagaataggaaaatctatggacaaaaagtagattaattcctgccaagagctagaagaagagggaacggaaagtgattgttaatgaggaggtgttttctcttggggataatgaaaatgttctggaatttgctatggcacaacttattaatagttaaaaatagtgaaatgatggaatcatacttttgaagtggtaaatttatggtacatgtatttttttaaaaaagaaagcaaactgacaacacatagaattgtggtgaagaataggaaagagcatcagtagagagcctctctggggtgcagcctactgagctcataaaagctgaagagggggcaggaactctgatataacactctcacatgatagacctcactctgcacacaggtagagacagatcaccattgggagactttgaaggtgatagcaaaaacaaagcctaaacccggctaaactactgaagaaattgaccacacacttccctcacacacaaacttacaacctagctgaataagatacattccaatttacatgcattaatattatttacctcagcctctactgttcttctacacatgaggactggcattcaataaaaattataaaatacaaaaaaattaataactagtaactcattttcatgaagaaaagcaataaacagacctggactcagaaatgacctaactgctgactacattacaaagatacttgaaaagaattgtgattaatatgtgtatcagtccgtttgcacactgccaacaaagacatactcgagagtgggaagattacaaagaggtttaatggacttacagttccacatgactggggaagcctcacaatcatggtggaaggcaaggaggagcaagtcacatcttacatggatggcagcaagcaaaaagagagagagcttgtgcagggaaactccccttcatagaaccatcagatctcatgagacttattcactatcacgagaacagcaggggaaacacctgcccttatgatttgattacctcccaccgggtccctcccacaacacgtgggaattcaagatgagatttgggtggggacacagccaaaccatatcgacatgttaaagaatatagtggaaaaactgaacaatatgcatgaagagaagtatcaagaaaatcatgaatcactgcacacacttgttaaaataattaattgggaggccataagactgaagcagctctagcaccctgagttcctatgtaaacaaactgaaactttactcaatacaaatggaaaaatgaaacaaactttaccaaagttggccagctaacctctaacaggggctttgccaatcagaaaccaccaaacaaccactaactaggggctttaagactactgctccactttttttttttttgagacagggtctcactctggtgcccaagctgttgtgcagtgttgtgataacggctcactgcaacctatgcctctcaggttcatgtgattctcatgccttagccacctgaatagccaggattacaggtgtgtgtcaccacacccaggtgatttttgtatttttagtagagatgaggttttgccaggttggccaggctggtctcgaactcctgacctcaagtgatctgtccacttcaaccttgtaatgtgctaggattacaggcatgagccactgctcctggccctacagctccacctaaaccaaaaaaaaaatattttctttgccttgcttctgcatgcacatcataaaagttctgccctcatgcccttttggtgaagccctggaccacttgtggttttatgctgcccaattcatgaattgctgtttgctgaaataaactctttacaattttaatttttctaagtttatcttgtaacacaactattttcagtttactgtacatattgaaacaaataactgatctctgagcgatgagagatagaaaataaagtgagccctaaaatttccttagcttactgcctggagggcagagtacacagcaggaaagccttgatgttttttgagttgaggaggtagaatttagaggacagggagactaaaatttgcagaacaaaataatgaagaggagaaagcggtacagagagaaatctccagagcttacatgggtttgaggatagttcttgtttcctctattcagagtgaaaaactttataaagcatgggacatcagctaaaaaccttaagagcgttttgtccaggttatgaggcattataagctatagactaaaaactgctctgatctcacctaaaaagagcaagacttgaaaaaaatgccactattttcaagaaacttacccatgctgaagaataaatcccaataatattttatagaaatacaaaactatctagcactcaacaaagtaaaattcaaaatgtcttccatccaatcacaatgaccaattttgtaaaaaagcagaaattaggatcaataatgaggataaaacacacacatgacactgataatagagattgtaggcaaagacatttaaaaatttatgaatgtatatgagaaccacaaagcagaggggaaaatgagggataaaaaaatacttgaggaaataatgaaaagttttcaggtttgataaaaactataaaccccaaaatctaataaactaaaaaaaaaatcacaaaacaataaacatgtataaaggtataccaaggcatttgataatcatattgtttaaaatcactgagattttaagaagaaatcacaagaaacttttaaaagtaaacagagatacaaattatgtacattacctacaaaggaacaaagataacgatgacagcagatttcttttgaaagataatgaaagccagaggagagtactatatttaaatattgaaggaaacaaatactaaagacgtaaacttctatattgatgaaaatatattccaagaataaagatgaaacacttttgtttcgggaatgcaaaattagaatgaatttatcaccaacatatgtgcactagaagaaatgttaaagtaagtcctccaggcagatggaaagtgatgccagagaaaaatccggatctacacaaaggaatcaagagccctagaaggtgcaactgcatgcataagtataaaacatattttccttattatgtaatgtcttcatagcaaagtaactgtttaaaataacagtacttaaaggtattaagttaaaaatagcaatgtatgatgtggcttacaacatatgtaaatgcaaaatgtatgcttagaatagaccataggatgagaagggggaaatggaagtataccgttggtttttatgtatctgactattctaagtgccaatgggtagagctgaatagagatgactgttttcctcattgcacatgaggtatactaataaggtgagcctgcacataacaagacatttttaaaaaacactcatcgtttattatgtgaacagagagagtgctgtgaactccagacaattactctgtaatattccttaaatgagaaactcttatagaaagaactttaccttgttttcttaaaggaaattaagagacatatctctaataaattttggttgagatgaagccatctgaacatcagtcaaggggattgtgcaccatgtgcggaagcagaggcaacaggtaaaagtaaaatgagtcaagatccttgctcttgttgagcatgcttgtacatggtctaagaacactctcaaaagaaggaaacacagtgaacatgcccatagtgctgtttggtgatgataggcagtagcaggggcctctttcccggaggagaggctgaagcagggctaggaatgaggttagagacagagattggggccaacactaaggaagatccttgcaaaattctcagagggatagtggattggagggagggagggtaaacagtcccattttgagaatagagaatagataaatatgtagaagaacagtgtgtgcctacgtgtgtttaggtcaggggtaggacaatgaagaactgggtaaacaagaggtgacatggtgaggtatgctgatgataaaaagattgggggctatcagttgttggcagggctggagagccaggaagcaaaattgggattcagtgcattgggcagaatggcatccacatagatatgtgcctgtgcaggggcatgatgaagcccacctttgaggaaggtcttctagcacagggctttcccagcagtgcaggggcatccccagtgttctgtagcaggtaaggcatcagggcccactgcctaaaggagggagaaaggatgctgggcgaacaggactctgggactagagtgctcacttcagccagactgctctgccttctaatgttcataaattggagttctatggaaggcttcagttaaaataagggattctatgtctaaaatttggcaaccatggtctactagtgagatatgggatgcattgtggtgtcctggcatcctctacttgtgcctaatattgctttcagccctttgcttcactgactttagttactgcaaagttgccagctgcctagaacacactagattagaagaggtttaacaaggaagtgtgtaccatctccatgggttttccatctaccctccaaatatctgcactttaaaccaatcctctattccagacattatctgctgacatatagacccacttttatagtcacaggacacaggttctctgttgtgacaaggacgcagaaaccatgggaggcattctgagctgggaacatcatctggatcatttttcatagccctttatctatagttactgaattagttggtcctgggcattcccactccagcttacccctccttgcagatgcacattcccttaccttgctcattggtattcctagcctgtatcaatggtcagccatcagtcaccagctccacttgcatagcacccacctctatgaaaggggtccagtgtacacaggaaaaaaattgtcagcctccactgggggtcaagacagctccctgccctggtgagagtgcacaggattactacagtgatcaagagaatgactcaggcagccagctatacccttcctgacaggagatggggaaattttaatgtaggctaattgtatatgtatatgtatgtgtatgtgtatatgtatatgtatatgtatatgtatatgtatatgtatatgtatatgtatgtgtatatgtatatgtacatacatatatcactccatgattcctgacattcttatagatcttgttatttcctaagtgagtaaaacaatacgaatatctttcattaaaatatttgtcctgttgtctttggttcccgaagcagcttcagaacagcttcggaatagtaaaggtggaagacagtcttctgttgtaatgttggagtgctttaggcctcagaaggagacctcggaaaacacaatctcgctttctaactttcttttgcccccctttcaccttcttctttttctccctaagacaagccatagaaactaaaaacagtcatctctcctcacctgtcttagagctggtcataaagaaattctctgacctaccttgtctgattgtaggtcttaaactcccatttcagaagaggtcctgacccataccctggaggacacaatgctgctcagggagaacaggaagaatctgaacagacaggccttgctggtttcccaactcagtctcttagtattaggttatatctttctgtccaatcatatttctacacatctgtccatgcttcaatcatgcctatccaatgaagtcttagtaaaagggtcaggaggacaggatattgagagcttctgaacagctgaattcatggaggcttccagaaaggtgcataagaactcatccacgtgccaggagagtgctgcaccccaactgcatgggaacagaagcccttgcagggcagaccctccagaactcgccctatgtacctctttatatggctgtttcattgtgtcctttaaaatatcctttgttataaaccagtaaacataaatatctccctgagttttgtgagctgatccagcaaatcaagcctaaagaaggggtcatgacaacctgaagttgaagccaatcagttagaagttccagaggcctggacttttgactagcatctgaagagagggcactgttgtgggactgagtcctcaacctgtggatctgatgctatctccagatagatagcgtcagaatggaattgaattaaaaggcacctagctggtgtctgctgtagaattgatttcttgctttttggtgaggagaaatccccatacattcagtcacagaagtcttctgtgttgattgttgtggtgtgaaagcagatgaaaacagatgaaagcagatgaaatgccctggtgcattcagctaccgggcctgctcactcacatcacgtggccatgttcagctggagattatggttcccagatttcccaagcctattcctgctcattgtcctgtcctccctactgcctttccccttatatccctcaggtccctgatcccactgggctgaactctggattgagagctctgagtgccagcctgcctggggctctgtggacttggttgtgtgcgtggtctctctcatggactctggcagttgccctttcttggatcctcctaatgcccctcatgagctgatggtgtcctgtcttctctccttccctgccatctggtcagtctgactgcattagtccattctcatgctactataaagaactggcagagactgggtaatttataaaggaaagaggtttaattgacacaaagtttcacaaggctagagaggcctcaggaaacttacaatcatgcaggaggggaaacaaatatgtccttcttcacatggtggcagcaaggagaagtgctgagcaaaaggggaaaaagccccatataaaaccatcagacaactcactcactatcacaagaacagcatgagggtaaccatccccatggttaaattacctctcaccatgttcctcccatgacacatagggattatgggaactaccattcaagatgagattttggtgggacacagccaaaccacaacattctgcccctggcccctcccatatctcatgtcctcacatttcaaaacaaaatcatgccttcctgacagtctcccaaagttttaactcatttcagaattaactgaaaagtacaacttccaaatctcatttgagacaaggcaagtcccttctgccgatgagcccgtaaaatcaaaagcaagttagttacttcttagatacaatgggggtaaagacatccattccacctgggagaaattggccaaaacaaaggggctacaggccccatgcaagtccaaaatccaataggtcagtcattaaaccttaaatttccaaaatgatctcctctgatttcatgtctcacatctaggtcacgctgatgcaagaggtggtctcccatggccttgggcagctctgcccctgtggcattgcagggtacaaccccccacccaacttccctcaaggaagatcccattctgggatctggaggactgtagttctcttctcacagttccactagggaataccccagtgaggacactgtgtggaggctccaaccccacatatcctttcatcactgctttagcagaggttctccatgagggccccacccctgcaagaatcttcttcctgaacatccaagagtttccatacatcctctgaagtaggcagaggttgccaaacctcaattcttgacttccctggaccggcaggctcaacaccacagggaagctgccaagacttggtgattgcaccctctgaagccatgacccgagctgtaccttggctccttgtagacacggctggaggggctggaacacagggcacccagtccctgggctgtacacagtatggtggccctggcccaggaaactatttttccctcctcagcctctggacctatgatgggaagggctgccgtgaaggtctctggcatgctctggagacattttccccattgtcttggtgattacatttgtctccatgttacttatgcaaatatctgcagttggcttgaatttctccccagaaaacgggattttcttttccactgcattgtcaggctacaaatgttccaatttatatgctctttcaccttttgaatgctttactgcttagaaatttcttctgctagatacgctaaatcatcactctcaagttcaaagttccacagatctctggggcaggggcaaaatgccaccagtctgtttgctagcatagcaagagtcgtctttattccagttccctacaagtttgtcatctctatctgagaccacttcagcctggacttcattgtccatatcactataagcattttggttaaagccattcaacaagtctctggaaagttctaaactcctacatcttcctgtctcctgagctctccaagtctctaggaagcttcaaactttcccacattttcctgacttctgagccctccaaactgttccaacctctgcctgttactcagttccagattcgcttccacagttttggtatctttacaacagctcgccactacccgttaccaatttactgtattagtccattcttatgctattataaagaactgcccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaactgcccaagactggttaatttataaagaatagaggtttaattgactcagtttcacagggctggggaggcctcaggaaacttccaatcatggtggaaggggaagcaaatatgtccttcttcacatagcagcagcaagaagtgcccagccaaagggggagaagctccttatacaaccatcagatctcatgagaactcactcactatcacaagaacggcagcatctgggtaaccactcctatgattcaatcacctcccacggatacctcccatgacacgtggggattatgggaactacaattcaagatggcatttgggtggggacacagccaaaccatatcactgaccaaacccttctcgaagtaaagataaatgggaatttcgtgtcagaagatgtttactgcacagtgatttccatggtctttcttcatgtaccactgtgagagaggctatggttttgaccacctaggaaagtttgtttatatgctcagtactcagttttaaataaggctacatcaaaggcattcttcatttctgttacattacctttgaattctagcactcactttagattatttaatacagttttcacctctttgctgtcatttcccatctattcttgtgtgttgtctactttttttattagaccttaaacatatgaatcactgatattttatattcatattttataagtataaaatttgtgttatactcagtctgcttttgcaacttgctttgtcacctcaggctctttttccttgccttgcgtcatgctgtggaagtttttgtgaaaaactgaatgtgatgtatttggtaatagtaaaccaagatgaaaagcttttagtgtgatactttctgttaatttgactaggtcttggacagggcttaatgtttgctgcagctgtaggtgccaaagccttcaatgccctgcagtattcttttttgtctccctcctattgtctttggttttcttaataactaccaattaaattaagcctctgtcttctagctcttcatccattgtaatccactgtcgatgtggttgtatcatccattgtaatccaccatcaatgtggttgtaaggtgttagggaaagaattgaaaccatctttgtaaatgttatacaattaatcagggaagaagagaggaggagaaatgaaaacaaaccaagctttcagcacagtcagcattaatcactaggttagcttgctctctgacccactcctcatagtcatttgtctctgcctcaaaatcacacagaccttgttatcagattataggtccccataattgctctatagatagcaacttaaacattctgaaacgttaagttttccttttgagatattctttccaatccttcataccagtgaaacctactgattgtagctggtctgaaggaccccaggaggagctggctcacggaagaatgcagtttccacatcctgatgacttcatccctcttaccccaaacaatcaacgactccaactttcagccccttgccctccatgatcctcttaaaaactgtcacgcgtatccatgtgaaaagaccaccaaacaggctttgtgtgagcaataaagctttttaatcacctgggtgcaggcgggctgactccaaaaagagagtaagcgaagggagataggggtggggcagttttataggattttggtgggtagtggaaaattacagtcaaaggggggttttctcttgcaggcaggggcgggggtcacagggtgctcagtggggcagcttctgagccaggagaaggaatttcacaaggttaatcactcagttaaggtagggcaggaacaaatcacagtggtggaatgtcatcagttaaggcaggaaccagccattttcacttcttttgtgattcttcacttgctttaggccatctgaatgtatatgtgcaggcttcggctcagaggcctgacaaaaatctcatcccagaactccttggggagatggatttgggggtctcctcccatctccttactcagggccctgtgatgattaaactctttctcttctgcaaactttgctgtcttagcgtattcaactgttactgctcagtgagcacatgaacctgttggtcctataacaggatcattctt

SEQ ID NO: 668 - DNA, 440107 bp, Homo sapiens
  misc_feature (38494)..(88493): n is a, c, g, or t
  misc_feature (88502)..(88504): n is a, c, g, or t
  misc_feature (88509)..(88511): n is a, c, g, or t
  misc_feature (88513)..(88517): n is a, c, g, or t
  misc_feature (88519)..(88519): n is a, c, g, or t
  misc_feature (88521)..(88521): n is a, c, g, or t
  misc_feature (88524)..(88530): n is a, c, g, or t
  misc_feature (88532)..(88532): n is a, c, g, or t
  misc_feature (88807)..(88808): n is a, c, g, or t
  misc_feature (88810)..(88823): n is a, c, g, or t
  misc_feature (88825)..(88825): n is a, c, g, or t
  misc_feature (88827)..(88830): n is a, c, g, or t
  misc_feature (88835)..(88835): n is a, c, g, or t
  misc_feature (88837)..(88838): n is a, c, g, or t
  misc_feature (88840)..(88840): n is a, c, g, or t
  misc_feature (88843)..(88845): n is a, c, g, or t
  misc_feature (88848)..(88848): n is a, c, g, or t
  misc_feature (88850)..(88852): n is a, c, g, or t
  misc_feature (88854)..(88855): n is a, c, g, or t
  misc_feature (88857)..(88860): n is a, c, g, or t
  misc_feature (88862)..(88866): n is a, c, g, or t
  misc_feature (88868)..(88873): n is a, c, g, or t
  misc_feature (88875)..(88875): n is a, c, g, or t
  misc_feature (88877)..(88881): n is a, c, g, or t
  misc_feature (88885)..(88895): n is a, c, g, or t
  misc_feature (88897)..(88899): n is a, c, g, or t
  misc_feature (88902)..(88902): n is a, c, g, or t
  misc_feature (88905)..(88912): n is a, c, g, or t
  misc_feature (88914)..(88914): n is a, c, g, or t
  misc_feature (88919)..(88919): n is a, c, g, or t
  misc_feature (88922)..(88922): n is a, c, g, or t
  misc_feature (88924)..(88924): n is a, c, g, or t
  misc_feature (88926)..(88927): n is a, c, g, or t
  misc_feature (88933)..(88933): n is a, c, g, or t
  misc_feature (88936)..(88936): n is a, c, g, or t
  misc_feature (88940)..(88942): n is a, c, g, or t
  misc_feature (88945)..(88945): n is a, c, g, or t
  misc_feature (88951)..(88953): n is a, c, g, or t
  misc_feature (88959)..(88961): n is a, c, g, or t
  misc_feature (88965)..(88967): n is a, c, g, or t
  misc_feature (88969)..(88969): n is a, c, g, or t
  misc_feature (88971)..(88971): n is a, c, g, or t
  misc_feature (88974)..(88974): n is a, c, g, or t
  misc_feature (88978)..(88978): n is a, c, g, or t
  misc_feature (88989)..(88989): n is a, c, g, or t
  misc_feature (88993)..(88993): n is a, c, g, or t
  misc_feature (89340)..(89340): n is a, c, g, or t
  misc_feature (89344)..(89346): n is a, c, g, or t
  misc_feature (89607)..(89607): n is a, c, g, or t
  misc_feature (89688)..(89688): n is a, c, g, or t
  misc_feature (89690)..(89690): n is a, c, g, or t
  misc_feature (89692)..(89692): n is a, c, g, or t
  misc_feature (89910)..(89910): n is a, c, g, or t
  misc_feature (90139)..(90139): n is a, c, g, or t
  misc_feature (90321)..(90321): n is a, c, g, or t
  misc_feature (90870)..(90870): n is a, c, g, or t
  misc_feature (91265)..(91265): n is a, c, g, or t
  misc_feature (91689)..(91689): n is a, c, g, or t
  misc_feature (92057)..(92057): n is a, c, g, or t
  misc_feature (92074)..(92076): n is a, c, g, or t
  misc_feature (92078)..(92079): n is a, c, g, or t
  misc_feature (92082)..(92083): n is a, c, g, or t
  misc_feature (92085)..(92100): n is a, c, g, or t
  misc_feature (92102)..(92103): n is a, c, g, or t
  misc_feature (92107)..(92113): n is a, c, g, or t
  misc_feature (92115)..(92116): n is a, c, g, or t
  misc_feature (92119)..(92120): n is a, c, g, or t
  misc_feature (92247)..(92247): n is a, c, g, or t
  misc_feature (92266)..(92266): n is a, c, g, or t
  misc_feature (92279)..(92280): n is a, c, g, or t
  misc_feature (92284)..(92284): n is a, c, g, or t
  misc_feature (92291)..(92291): n is a, c, g, or t
  misc_feature (92293)..(92294): n is a, c, g, or t
  misc_feature (92296)..(92296): n is a, c, g, or t
  misc_feature (92298)..(92298): n is a, c, g, or t
  misc_feature (92300)..(92300): n is a, c, g, or t
  misc_feature (92303)..(92303): n is a, c, g, or t
  misc_feature (92314)..(92314): n is a, c, g, or t
  misc_feature (92316)..(92316): n is a, c, g, or t
  misc_feature (92319)..(92319): n is a, c, g, or t
  misc_feature (92324)..(92324): n is a, c, g, or t
  misc_feature (92327)..(92327): n is a, c, g, or t
  misc_feature (92330)..(92330): n is a, c, g, or t
  misc_feature (92335)..(92336): n is a, c, g, or t
  misc_feature (92338)..(92338): n is a, c, g, or t
  misc_feature (92341)..(92349): n is a, c, g, or t
  misc_feature (92353)..(92353): n is a, c, g, or t
  misc_feature (92357)..(92358): n is a, c, g, or t
  misc_feature (92362)..(92372): n is a, c, g, or t
  misc_feature (92375)..(92376): n is a, c, g, or t
  misc_feature (92378)..(92379): n is a, c, g, or t
  misc_feature (92381)..(92381): n is a, c, g, or t
  misc_feature (92388)..(92388): n is a, c, g, or t
  misc_feature (92390)..(92391): n is a, c, g, or t
  misc_feature (92393)..(92398): n is a, c, g, or t
  misc_feature (92401)..(92406): n is a, c, g, or t
  misc_feature (92408)..(92409): n is a, c, g, or t
  misc_feature (92411)..(92412): n is a, c, g, or t
  misc_feature (92414)..(92414): n is a, c, g, or t
  misc_feature (92416)..(92420): n is a, c, g, or t
  misc_feature (92422)..(92423): n is a, c, g, or t
  misc_feature (92425)..(92426): n is a, c, g, or t
  misc_feature (92429)..(92429): n is a, c, g, or t
  misc_feature (92431)..(92432): n is a, c, g, or t
  misc_feature (92434)..(92439): n is a, c, g, or t
  misc_feature (92441)..(92449): n is a, c, g, or t
  misc_feature (92451)..(92451): n is a, c, g, or t
  misc_feature (92454)..(92460): n is a, c, g, or t
  misc_feature (92462)..(92463): n is a, c, g, or t
  misc_feature (92466)..(92480): n is a, c, g, or t
  misc_feature (92482)..(92493): n is a, c, g, or t
  misc_feature (92495)..(92495): n is a, c, g, or t
  misc_feature (92497)..(92497): n is a, c, g, or t
  misc_feature (92499)..(92502): n is a, c, g, or t
  misc_feature (92505)..(92514): n is a, c, g, or t
  misc_feature (92516)..(92516): n is a, c, g, or t
  misc_feature (92519)..(92519): n is a, c, g, or t
  misc_feature (92521)..(92533): n is a, c, g, or t
  misc_feature (92535)..(92537): n is a, c, g, or t
  misc_feature (92540)..(92544): n is a, c, g, or t
  misc_feature (92547)..(92547): n is a, c, g, or t
  misc_feature (92549)..(92549): n is a, c, g, or t
  misc_feature (92551)..(92558): n is a, c, g, or t
  misc_feature (92560)..(92560): n is a, c, g, or t
  misc_feature (92562)..(92562): n is a, c, g, or t
  misc_feature (92564)..(92564): n is a, c, g, or t
  misc_feature (92566)..(92570): n is a, c, g, or t
  misc_feature (92572)..(92671): n is a, c, g, or t
  misc_feature (92804)..(92807): n is a, c, g, or t
  misc_feature (92810)..(92810): n is a, c, g, or t
  misc_feature (92812)..(92826): n is a, c, g, or t
  misc_feature (92828)..(92828): n is a, c, g, or t
  misc_feature (92831)..(92834): n is a, c, g, or t
  misc_feature (92836)..(92836): n is a, c, g, or t
  misc_feature (92910)..(92913): n is a, c, g, or t
  misc_feature (92923)..(92923): n is a, c, g, or t
  misc_feature (92933)..(92933): n is a, c, g, or t
  misc_feature (92941)..(92941): n is a, c, g, or t
  misc_feature (92977)..(92977): n is a, c, g, or t
  misc_feature (92986)..(92986): n is a, c, g, or t
  misc_feature (92989)..(92989): n is a, c, g, or t
  misc_feature (92991)..(92991): n is a, c, g, or t
  misc_feature (92996)..(92996): n is a, c, g, or t
  misc_feature (92999)..(92999): n is a, c, g, or t
  misc_feature (93139)..(93139): n is a, c, g, or t
  misc_feature (93199)..(93199): n is a, c, g, or t
  misc_feature (93807)..(93807): n is a, c, g, or t
  misc_feature (93943)..(93943): n is a, c, g, or t
  misc_feature (93977)..(93977): n is a, c, g, or t
  misc_feature (94058)..(94058): n is a, c, g, or t
  misc_feature (94304)..(94304): n is a, c, g, or t
  misc_feature (94325)..(94325): n is a, c, g, or t
  misc_feature (94400)..(94400): n is a, c, g, or t
  misc_feature (94408)..(94408): n is a, c, g, or t
  misc_feature (94411)..(94411): n is a, c, g, or t
  misc_feature (94453)..(94453): n is a, c, g, or t
  misc_feature (94506)..(94506): n is a, c, g, or t
  misc_feature (95492)..(95492): n is a, c, g, or t
  misc_feature (95580)..(95580): n is a, c, g, or t
  misc_feature (95588)..(95588): n is a, c, g, or t
  misc_feature (95700)..(95700): n is a, c, g, or t
  misc_feature (95775)..(95775): n is a, c, g, or t
  misc_feature (95876)..(95876): n is a, c, g, or t
  misc_feature (95907)..(95907): n is a, c, g, or t
  misc_feature (96048)..(96049): n is a, c, g, or t
  misc_feature (96074)..(96074): n is a, c, g, or t
  misc_feature (96203)..(96203): n is a, c, g, or t
  misc_feature (96443)..(96443): n is a, c, g, or t
  misc_feature (96451)..(96451): n is a, c, g, or t
  misc_feature (97210)..(97210): n is a, c, g, or t
  misc_feature (97414)..(97414): n is a, c, g, or t
  misc_feature (97483)..(97484): n is a, c, g, or t
  misc_feature (97737)..(97737): n is a, c, g, or t
  misc_feature (97984)..(97984): n is a, c, g, or t
  misc_feature (98038)..(98038): n is a, c, g, or t
  misc_feature (98041)..(98041): n is a, c, g, or t
  misc_feature (98419)..(98419): n is a, c, g, or t
  misc_feature (98574)..(98574): n is a, c, g, or t
  misc_feature (98860)..(98860): n is a, c, g, or t
  misc_feature (98911)..(98911): n is a, c, g, or t
  misc_feature (99155)..(99155): n is a, c, g, or t
  misc_feature (99435)..(99436): n is a, c, g, or t
  misc_feature (99439)..(99439): n is a, c, g, or t
  misc_feature (99531)..(99531): n is a, c, g, or t
  misc_feature (99598)..(99598): n is a, c, g, or t
  misc_feature (99758)..(99758): n is a, c, g, or t
  misc_feature (99766)..(99766): n is a, c, g, or t
  misc_feature (100190)..(100190): n is a, c, g, or t
  misc_feature (100204)..(100204): n is a, c, g, or t
  misc_feature (100215)..(100215): n is a, c, g, or t
  misc_feature (100251)..(100251): n is a, c, g, or t
  misc_feature (100268)..(100268): n is a, c, g, or t
  misc_feature (100279)..(100279): n is a, c, g, or t
  misc_feature (100291)..(100291): n is a, c, g, or t
  misc_feature (100296)..(100296): n is a, c, g, or t
  misc_feature (100302)..(100302): n is a, c, g, or t
  misc_feature (100309)..(100309): n is a, c, g, or t
  misc_feature (100315)..(100315): n is a, c, g, or t
  misc_feature (100324)..(100324): n is a, c, g, or t
  misc_feature (100329)..(100331): n is a, c, g, or t
  misc_feature (100333)..(100333): n is a, c, g, or t
  misc_feature (100335)..(100335): n is a, c, g, or t
  misc_feature (100337)..(100340): n is a, c, g, or t
  misc_feature (100343)..(100347): n is a, c, g, or t
  misc_feature (100349)..(100349): n is a, c, g, or t
  misc_feature (100351)..(100351): n is a, c, g, or t
  misc_feature (100353)..(100353): n is a, c, g, or t
  misc_feature (100355)..(100362): n is a, c, g, or t
  misc_feature (100365)..(100366): n is a, c, g, or t
  misc_feature (100368)..(100374): n is a, c, g, or t
  misc_feature (100377)..(100382): n is a, c, g, or t
  misc_feature (100384)..(100386): n is a, c, g, or t
  misc_feature (100388)..(100390): n is a, c, g, or t
  misc_feature (100392)..(100394): n is a, c, g, or t
  misc_feature (100396)..(100414): n is a, c, g, or t
  misc_feature (100416)..(100417): n is a, c, g, or t
  misc_feature (100421)..(100421): n is a, c, g, or t
  misc_feature (100423)..(100424): n is a, c, g, or t
  misc_feature (100426)..(100429): n is a, c, g, or t
  misc_feature (100431)..(100433): n is a, c, g, or t
  misc_feature (100444)..(100444): n is a, c, g, or t
  misc_feature (100451)..(100575): n is a, c, g, or t
  misc_feature (100577)..(100590): n is a, c, g, or t
  misc_feature (100593)..(100598): n is a, c, g, or t
  misc_feature (100600)..(100600): n is a, c, g, or t
  misc_feature (100602)..(100602): n is a, c, g, or t
  misc_feature (100604)..(100609): n is a, c, g, or t
  misc_feature (100611)..(100618): n is a, c, g, or t
  misc_feature (100620)..(100625): n is a, c, g, or t
  misc_feature (100627)..(100629): n is a, c, g, or t
  misc_feature (100634)..(100643): n is a, c, g, or t
  misc_feature (100645)..(100645): n is a, c, g, or t
  misc_feature (100689)..(100690): n is a, c, g, or t
  misc_feature (100727)..(100727): n is a, c, g, or t
  misc_feature (100769)..(100769): n is a, c, g, or t
  misc_feature (101299)..(101299): n is a, c, g, or t
  misc_feature (101328)..(101328): n is a, c, g, or t
  misc_feature (101526)..(101526): n is a, c, g, or t
  misc_feature (102170)..(102171): n is a, c, g, or t
  misc_feature (102623)..(102623): n is a, c, g, or t
  misc_feature (102625)..(102625): n is a, c, g, or t
  misc_feature (102835)..(102835): n is a, c, g, or t
  misc_feature (102840)..(102840): n is a, c, g, or t
  misc_feature (102905)..(102905): n is a, c, g, or t
  misc_feature (102909)..(102909): n is a, c, g, or t
  misc_feature (103160)..(103160): n is a, c, g, or t
  misc_feature (103216)..(103217): n is a, c, g, or t
  misc_feature (103250)..(103250): n is a, c, g, or t
  misc_feature (103261)..(103261): n is a, c, g, or t
  misc_feature (103265)..(103269): n is a, c, g, or t
  misc_feature (103271)..(103271): n is a, c, g, or t
  misc_feature (103275)..(103275): n is a, c, g, or t
  misc_feature (103280)..(103283): n is a, c, g, or t
  misc_feature (103289)..(103290): n is a, c, g, or t
  misc_feature (103293)..(103293): n is a, c, g, or t
  misc_feature (103332)..(103333): n is a, c, g, or t
  misc_feature (103366)..(103366): n is a, c, g, or t
  misc_feature (103398)..(103398): n is a, c, g, or t
  misc_feature (103401)..(103401): n is a, c, g, or t
  misc_feature (103432)..(103432): n is a, c, g, or t
  misc_feature (103548)..(103548): n is a, c, g, or t
  misc_feature (103606)..(103606): n is a, c, g, or t
  misc_feature (103668)..(103668): n is a, c, g, or t
  misc_feature (103679)..(103679): n is a, c, g, or t
  misc_feature (103686)..(103686): n is a, c, g, or t
  misc_feature (103741)..(103741): n is a, c, g, or t
  misc_feature (103747)..(103747): n is a, c, g, or t
  misc_feature (104097)..(104097): n is a, c, g, or t
  misc_feature (104139)..(104139): n is a, c, g, or t
  misc_feature (104442)..(104442): n is a, c, g, or t
  misc_feature (104461)..(104461): n is a, c, g, or t
  misc_feature (104571)..(104571): n is a, c, g, or t
  misc_feature (104590)..(104590): n is a, c, g, or t
  misc_feature (104789)..(104789): n is a, c, g, or t
  misc_feature (104895)..(104895): n is a, c, g, or t
  misc_feature (104933)..(104933): n is a, c, g, or t
  misc_feature (105310)..(105310): n is a, c, g, or t
  misc_feature (105419)..(105419): n is a, c, g, or t
  misc_feature (105511)..(105511): n is a, c, g, or t
  misc_feature (105904)..(105904): n is a, c, g, or t
  misc_feature (105929)..(105929): n is a, c, g, or t
  misc_feature (106895)..(106895): n is a, c, g, or t
  misc_feature (106936)..(106936): n is a, c, g, or t
  misc_feature (106942)..(106949): n is a, c, g, or t
  misc_feature (106951)..(106952): n is a, c, g, or t
  misc_feature (106954)..(106955): n is a, c, g, or t
  misc_feature (106957)..(106962): n is a, c, g, or t
  misc_feature (106966)..(106973): n is a, c, g, or t
  misc_feature (106975)..(106975): n is a, c, g, or t
  misc_feature (106985)..(106985): n is a, c, g, or t
  misc_feature (106989)..(106989): n is a, c, g, or t
  misc_feature (106996)..(106996): n is a, c, g, or t
  misc_feature (107013)..(107013): n is a, c, g, or t
  misc_feature (107031)..(107031): n is a, c, g, or t
  misc_feature (107036)..(107036): n is a, c, g, or t
  misc_feature (107258)..(107258): n is a, c, g, or t
  misc_feature (107260)..(107260): n is a, c, g, or t
  misc_feature (107262)..(107273): n is a, c, g, or t
  misc_feature (107276)..(107277): n is a, c, g, or t
  misc_feature (107279)..(107280): n is a, c, g, or t
  misc_feature (107282)..(107282): n is a, c, g, or t
  misc_feature (107284)..(107287): n is a, c, g, or t
  misc_feature (107322)..(107322): n is a, c, g, or t
  misc_feature (107355)..(107355): n is a, c, g, or t
  misc_feature (107412)..(107412): n is a, c, g, or t
  misc_feature (107416)..(107416): n is a, c, g, or t
  misc_feature (107563)..(107563): n is a, c, g, or t
  misc_feature (107578)..(107578): n is a, c, g, or t
  misc_feature (107592)..(107592): n is a, c, g, or t
  misc_feature (108229)..(108229): n is a, c, g, or t
  misc_feature (108418)..(108418): n is a, c, g, or t
  misc_feature (109029)..(109029): n is a, c, g, or t
  misc_feature (109585)..(109585): n is a, c, g, or t
  misc_feature (109883)..(109883): n is a, c, g, or t
  misc_feature (109889)..(109889): n is a, c, g, or t
  misc_feature (109963)..(109963): n is a, c, g, or t
  misc_feature (110055)..(110055): n is a, c, g, or t
  misc_feature (110140)..(110140): n is a, c, g, or t
  misc_feature (110338)..(110338): n is a, c, g, or t
  misc_feature (110340)..(110340): n is a, c, g, or t
  misc_feature (110349)..(110349): n is a, c, g, or t
  misc_feature (110358)..(110358): n is a, c, g, or t
  misc_feature (110361)..(110361): n is a, c, g, or t
  misc_feature (110370)..(110370): n is a, c, g, or t
  misc_feature (110372)..(110372): n is a, c, g, or t
  misc_feature (110379)..(110379): n is a, c, g, or t
  misc_feature (110389)..(110389): n is a, c, g, or t
  misc_feature (110392)..(110392): n is a, c, g, or t
  misc_feature (110395)..(110395): n is a, c, g, or t
  misc_feature (110397)..(110397): n is a, c, g, or t
  misc_feature (110399)..(110400): n is a, c, g, or t
  misc_feature (110402)..(110402): n is a, c, g, or t
  misc_feature (110405)..(110406): n is a, c, g, or t
  misc_feature (110409)..(110419): n is a, c, g, or t
  misc_feature (110421)..(110432): n is a, c, g, or t
  misc_feature (110437)..(110439): n is a, c, g, or t
  misc_feature (110443)..(110443): n is a, c, g, or t
  misc_feature (110445)..(110454): n is a, c, g, or t
  misc_feature (110456)..(110458): n is a, c, g, or t
  misc_feature (110460)..(110465): n is a, c, g, or t
  misc_feature (110467)..(110468): n is a, c, g, or t
  misc_feature (110470)..(110471): n is a, c, g, or t
  misc_feature (110473)..(110478): n is a, c, g, or t
  misc_feature (110480)..(110480): n is a, c, g, or t
  misc_feature (110482)..(110482): n is a, c, g, or t
  misc_feature (110485)..(110497): n is a, c, g, or t
  misc_feature (110500)..(110523): n is a, c, g, or t
  misc_feature (110526)..(110537): n is a, c, g, or t
  misc_feature (110539)..(110555): n is a, c, g, or t
  misc_feature (110581)..(110581): n is a, c, g, or t
  misc_feature (110711)..(110711): n is a, c, g, or t
  misc_feature (110717)..(110717): n is a, c, g, or t
  misc_feature (110725)..(110726): n is a, c, g, or t
  misc_feature (110728)..(110731): n is a, c, g, or t
  misc_feature (110733)..(110743): n is a, c, g, or t
  misc_feature (110745)..(110746): n is a, c, g, or t
  misc_feature (110848)..(110848): n is a, c, g, or t
  misc_feature (111205)..(111205): n is a, c, g, or t
  misc_feature (111308)..(111308): n is a, c, g, or t
  misc_feature (111350)..(111350): n is a, c, g, or t
  misc_feature (111491)..(111491): n is a, c, g, or t
  misc_feature (111516)..(111516): n is a, c, g, or t
  misc_feature (111543)..(111543): n is a, c, g, or t
  misc_feature (111545)..(111545): n is a, c, g, or t
  misc_feature (111547)..(111547): n is a, c, g, or t
  misc_feature (111560)..(111560): n is a, c, g, or t
  misc_feature (111570)..(111570): n is a, c, g, or t
  misc_feature (111576)..(111577): n is a, c, g, or t
  misc_feature (111580)..(111580): n is a, c, g, or t
  misc_feature (111587)..(111587): n is a, c, g, or t
  misc_feature (111592)..(111592): n is a, c, g, or t
  misc_feature (111598)..(111598): n is a, c, g, or t
  misc_feature (111609)..(111609): n is a, c, g, or t
  misc_feature (111617)..(111617): n is a, c, g, or t
  misc_feature (111623)..(111623): n is a, c, g, or t
  misc_feature (111634)..(111634): n is a, c, g, or t
  misc_feature (111638)..(111639): n is a, c, g, or t
  misc_feature (111702)..(111711): n is a, c, g, or t
  misc_feature (111715)..(111715): n is a, c, g, or t
  misc_feature (111726)..(111726): n is a, c, g, or t
  misc_feature (111728)..(111728): n is a, c, g, or t
  misc_feature (111731)..(111731): n is a, c, g, or t
  misc_feature (111734)..(111734): n is a, c, g, or t
  misc_feature (111742)..(111742): n is a, c, g, or t
  misc_feature (111747)..(111747): n is a, c, g, or t
  misc_feature (111750)..(111751): n is a, c, g, or t
  misc_feature (111767)..(111767): n is a, c, g, or t
  misc_feature (111769)..(111769): n is a, c, g, or t
  misc_feature (111771)..(111771): n is a, c, g, or t
  misc_feature (111774)..(111774): n is a, c, g, or t
  misc_feature (111776)..(111777): n is a, c, g, or t
  misc_feature (111779)..(111795): n is a, c, g, or t
  misc_feature (111968)..(111968): n is a, c, g, or t
  misc_feature (111970)..(111970): n is a, c, g, or t
  misc_feature (112195)..(112195): n is a, c, g, or t
  misc_feature (112221)..(112221): n is a, c, g, or t
  misc_feature (112226)..(112226): n is a, c, g, or t
  misc_feature (112232)..(112232): n is a, c, g, or t
  misc_feature (112245)..(112245): n is a, c, g, or t
  misc_feature (112264)..(112264): n is a, c, g, or t
  misc_feature (112362)..(112362): n is a, c, g, or t
  misc_feature (112370)..(112370): n is a, c, g, or t
  misc_feature (112372)..(112372): n is a, c, g, or t
  misc_feature (112387)..(112387): n is a, c, g, or t
  misc_feature (112391)..(112394): n is a, c, g, or t
  misc_feature (112396)..(112403): n is a, c, g, or t
  misc_feature (112405)..(112410): n is a, c, g, or t
  misc_feature (112413)..(112416): n is a, c, g, or t
  misc_feature (112418)..(112422): n is a, c, g, or t
  misc_feature (112430)..(112430): n is a, c, g, or t
  misc_feature (112432)..(112432): n is a, c, g, or t
  misc_feature (112435)..(112435): n is a, c, g, or t
  misc_feature (112444)..(112444): n is a, c, g, or t
  misc_feature (112458)..(112458): n is a, c, g, or t
  misc_feature (112460)..(112460): n is a, c, g, or t
  misc_feature (112463)..(112463): n is a, c, g, or t
  misc_feature (112466)..(112466): n is a, c, g, or t
  misc_feature (112473)..(112473): n is a, c, g, or t
  misc_feature (112479)..(112480): n is a, c, g, or t
  misc_feature (112482)..(112482): n is a, c, g, or t
  misc_feature (112484)..(112485): n is a, c, g, or t
  misc_feature (112487)..(112492): n is a, c, g, or t
  misc_feature (112494)..(112495): n is a, c, g, or t
  misc_feature (112497)..(112497): n is a, c, g, or t
  misc_feature (112499)..(112502): n is a, c, g, or t
  misc_feature (112504)..(112504): n is a, c, g, or t
  misc_feature (112508)..(112508): n is a, c, g, or t
  misc_feature (112699)..(112699): n is a, c, g, or t
  misc_feature (112763)..(112764): n is a, c, g, or t
  misc_feature (112767)..(112770): n is a, c, g, or t
  misc_feature (112772)..(112775): n is a, c, g, or t
  misc_feature (112784)..(112784): n is a, c, g, or t
  misc_feature (112788)..(112788): n is a, c, g, or t
  misc_feature (112791)..(112792): n is a, c, g, or t
  misc_feature (112799)..(112799): n is a, c, g, or t
  misc_feature (112812)..(112812): n is a, c, g, or t
  misc_feature (112822)..(112823): n is a, c, g, or t
  misc_feature (112836)..(112836): n is a, c, g, or t
  misc_feature (112842)..(112843): n is a, c, g, or t
  misc_feature (112848)..(112848): n is a, c, g, or t
  misc_feature (112852)..(112852): n is a, c, g, or t
  misc_feature (112856)..(112856): n is a, c, g, or t
  misc_feature (112864)..(112864): n is a, c, g, or t
  misc_feature (112868)..(112869): n is a, c, g, or t
  misc_feature (112873)..(112873): n is a, c, g, or t
  misc_feature (112876)..(112876): n is a, c, g, or t
  misc_feature (112878)..(112878): n is a, c, g, or t
  misc_feature (112881)..(112882): n is a, c, g, or t
  misc_feature (112910)..(112910): n is a, c, g, or t
  misc_feature (112920)..(112920): n is a, c, g, or t
  misc_feature (113245)..(113245): n is a, c, g, or t
  misc_feature (113784)..(113784): n is a, c, g, or t
  misc_feature (113914)..(113914): n is a, c, g, or t
  misc_feature (113916)..(113916): n is a, c, g, or t
  misc_feature (113955)..(113955): n is a, c, g, or t
  misc_feature (113965)..(113965): n is a, c, g, or t
  misc_feature (113974)..(113974): n is a, c, g, or t
  misc_feature (113978)..(113978): n is a, c, g, or t
  misc_feature (113987)..(113987): n is a, c, g, or t
  misc_feature (113997)..(113997): n is a, c, g, or t
  misc_feature (114008)..(114008): n is a, c, g, or t
  misc_feature (114013)..(114013): n is a, c, g, or t
  misc_feature (114017)..(114017): n is a, c, g, or t
  misc_feature (114026)..(114026): n is a, c, g, or t
  misc_feature (114033)..(114033): n is a, c, g, or t
  misc_feature (114035)..(114035): n is a, c, g, or t
  misc_feature (114037)..(114037): n is a, c, g, or t
  misc_feature (114050)..(114050): n is a, c, g, or t
  misc_feature (114055)..(114055): n is a, c, g, or t
  misc_feature (114059)..(114059): n is a, c, g, or t
  misc_feature (114066)..(114078): n is a, c, g, or t
  misc_feature (114080)..(114081): n is a, c, g, or t
  misc_feature (114083)..(114089): n is a, c, g, or t
  misc_feature (114091)..(114093): n is a, c, g, or t
  misc_feature (114496)..(114499): n is a, c, g, or t
  misc_feature (114501)..(114501): n is a, c, g, or t
  misc_feature (114503)..(114503): n is a, c, g, or t
  misc_feature (114505)..(114505): n is a, c, g, or t
  misc_feature (114507)..(114509): n is a, c, g, or t
  misc_feature (114511)..(114514): n is a, c, g, or t
  misc_feature (114517)..(114523): n is a, c, g, or t
  misc_feature (114525)..(114531): n is a, c, g, or t
  misc_feature (114594)..(114594): n is a, c, g, or t
  misc_feature (114667)..(114667): n is a, c, g, or t
  misc_feature (114703)..(114703): n is a, c, g, or t
  misc_feature (114705)..(114705): n is a, c, g, or t
  misc_feature (115436)..(115436): n is a, c, g, or t
  misc_feature (115487)..(115487): n is a, c, g, or t
  misc_feature (115867)..(115867): n is a, c, g, or t
  misc_feature (116122)..(116122): n is a, c, g, or t
  misc_feature (116124)..(116138): n is a, c, g, or t
  misc_feature (116142)..(116142): n is a, c, g, or t
  misc_feature (116144)..(116148): n is a, c, g, or t
  misc_feature (116170)..(116170): n is a, c, g, or t
  misc_feature (116172)..(116179): n is a, c, g, or t
  misc_feature (116183)..(116188): n is a, c, g, or t
  misc_feature (116242)..(116245): n is a, c, g, or t
  misc_feature (116248)..(116254): n is a, c, g, or t
  misc_feature (116256)..(116256): n is a, c, g, or t
  misc_feature (116259)..(116259): n is a, c, g, or t
  misc_feature (116261)..(116263): n is a, c, g, or t
  misc_feature (116267)..(116268): n is a, c, g, or t
  misc_feature (116275)..(116275): n is a, c, g, or t
  misc_feature (116282)..(116282): n is a, c, g, or t
  misc_feature (116322)..(116322): n is a, c, g, or t
  misc_feature (116382)..(116382): n is a, c, g, or t
  misc_feature (116825)..(116825): n is a, c, g, or t
  misc_feature (117235)..(117235): n is a, c, g, or t
  misc_feature (117342)..(117342): n is a, c, g, or t
  misc_feature (117452)..(117452): n is a, c, g, or t
  misc_feature (117457)..(117457): n is a, c, g, or t
  misc_feature (117508)..(117508): n is a, c, g, or t
  misc_feature (117549)..(117549): n is a, c, g, or t
  misc_feature (117560)..(117560): n is a, c, g, or t
  misc_feature (117564)..(117564): n is a, c, g, or t
  misc_feature (117613)..(117613): n is a, c, g, or t
  misc_feature (117619)..(117620): n is a, c, g, or t
  misc_feature (117622)..(117622): n is a, c, g, or t
  misc_feature (117624)..(117626): n is a, c, g, or t
  misc_feature (117628)..(117628): n is a, c, g, or t
  misc_feature (117630)..(117635): n is a, c, g, or t
  misc_feature (117637)..(117642): n is a, c, g, or t
  misc_feature (117678)..(117678): n is a, c, g, or t
  misc_feature (117681)..(117681): n is a, c, g, or t
  misc_feature (117694)..(117694): n is a, c, g, or t
  misc_feature (117903)..(117903): n is a, c, g, or t
  misc_feature (117932)..(117935): n is a, c, g, or t
  misc_feature (117937)..(117941): n is a, c, g, or t
  misc_feature (117943)..(117945): n is a, c, g, or t
  misc_feature (117948)..(117955): n is a, c, g, or t
  misc_feature (117958)..(117963): n is a, c, g, or t
  misc_feature (118177)..(118180): n is a, c, g, or t
  misc_feature (118184)..(118184): n is a, c, g, or t
  misc_feature (118186)..(118186): n is a, c, g, or t
  misc_feature (118246)..(118246): n is a, c, g, or t
  misc_feature (118256)..(118256): n is a, c, g, or t
  misc_feature (118280)..(118280): n is a, c, g, or t
  misc_feature (118283)..(118283): n is a, c, g, or t
  misc_feature (118363)..(118363): n is a, c, g, or t
  misc_feature (118388)..(118388): n is a, c, g, or t
  misc_feature (118893)..(118893): n is a, c, g, or t
  misc_feature (118907)..(118907): n is a, c, g, or t
  misc_feature (118954)..(118954): n is a, c, g, or t
  misc_feature (119024)..(119024): n is a, c, g, or t
  misc_feature (119058)..(119058): n is a, c, g, or t
  misc_feature (119124)..(119124): n is a, c, g, or t
  misc_feature (119189)..(119189): n is a, c, g, or t
  misc_feature (119197)..(119198): n is a, c, g, or t
  misc_feature (119202)..(119202): n is a, c, g, or t
  misc_feature (119207)..(119207): n is a, c, g, or t
  misc_feature (119218)..(119218): n is a, c, g, or t
  misc_feature (119295)..(119295): n is a, c, g, or t
  misc_feature (119302)..(119302): n is a, c, g, or t
  misc_feature (120878)..(120878): n is a, c, g, or t
  misc_feature (121154)..(121154): n is a, c, g, or t
  misc_feature (121176)..(121176): n is a, c, g, or t
  misc_feature (121194)..(121194): n is a, c, g, or t
  misc_feature (121199)..(121199): n is a, c, g, or t
  misc_feature (121264)..(121264): n is a, c, g, or t
  misc_feature (121578)..(121578): n is a, c, g, or t
  misc_feature (121649)..(121649): n is a, c, g, or t
  misc_feature (121787)..(121787): n is a, c, g, or t
  misc_feature (121802)..(121802): n is a, c, g, or t
  misc_feature (122918)..(122918): n is a, c, g, or t
  misc_feature (122938)..(122940): n is a, c, g, or t
  misc_feature (123060)..(123060): n is a, c, g, or t
  misc_feature (123072)..(123072): n is a, c, g, or t
  misc_feature (123080)..(123082): n is a, c, g, or t
  misc_feature (123084)..(123084): n is a, c, g, or t
  misc_feature (123086)..(123092): n is a, c, g, or t
  misc_feature (123094)..(123113): n is a, c, g, or t
  misc_feature (123115)..(123122): n is a, c, g, or t
  misc_feature (123124)..(123124): n is a, c, g, or t
  misc_feature (123127)..(123129): n is a, c, g, or t
  misc_feature (123132)..(123132): n is a, c, g, or t
  misc_feature (123134)..(123135): n is a, c, g, or t
  misc_feature (123139)..(123143): n is a, c, g, or t
  misc_feature (123145)..(123159): n is a, c, g, or t
  misc_feature (123162)..(123164): n is a, c, g, or t
  misc_feature (123166)..(123169): n is a, c, g, or t
  misc_feature (123171)..(123178): n is a, c, g, or t
  misc_feature (123180)..(123182): n is a, c, g, or t
  misc_feature (123184)..(123187): n is a, c, g, or t
  misc_feature (123189)..(123189): n is a, c, g, or t
  misc_feature (123191)..(123191): n is a, c, g, or t
  misc_feature (123194)..(123199): n is a, c, g, or t
  misc_feature (123201)..(123201): n is a, c, g, or t
  misc_feature (123203)..(123204): n is a, c, g, or t
  misc_feature (123206)..(123214): n is a, c, g, or t
  misc_feature (123216)..(123216): n is a, c, g, or t
  misc_feature (123218)..(123220): n is a, c, g, or t
  misc_feature (123222)..(123232): n is a, c, g, or t
  misc_feature (123234)..(123236): n is a, c, g, or t
  misc_feature (123238)..(123242): n is a, c, g, or t
  misc_feature (123244)..(123244): n is a, c, g, or t
  misc_feature (123246)..(123246): n is a, c, g, or t
  misc_feature (123248)..(123258): n is a, c, g, or t
  misc_feature (123260)..(123262): n is a, c, g, or t
  misc_feature (123264)..(123264): n is a, c, g, or t
  misc_feature (123268)..(123268): n is a, c, g, or t
  misc_feature (123271)..(123271): n is a, c, g, or t
  misc_feature (123273)..(123273): n is a, c, g, or t
  misc_feature (123278)..(123279): n is a, c, g, or t
  misc_feature (123283)..(123285): n is a, c, g, or t
  misc_feature (123320)..(123320): n is a, c, g, or t
  misc_feature (123324)..(123326): n is a, c, g, or t
  misc_feature (123333)..(123333): n is a, c, g, or t
  misc_feature (123335)..(123336): n is a, c, g, or t
  misc_feature (123340)..(123340): n is a, c, g, or t
  misc_feature (123342)..(123342): n is a, c, g, or t
  misc_feature (123344)..(123344): n is a, c, g, or t
  misc_feature (123346)..(123346): n is a, c, g, or t
  misc_feature (123355)..(123355): n is a, c, g, or t
  misc_feature (123357)..(123357): n is a, c, g, or t
  misc_feature (123361)..(123361): n is a, c, g, or t
  misc_feature (123364)..(123364): n is a, c, g, or t
  misc_feature (123366)..(123366): n is a, c, g, or t
  misc_feature (123368)..(123368): n is a, c, g, or t
  misc_feature (123376)..(123376): n is a, c, g, or t
  misc_feature (123378)..(123378): n is a, c, g, or t
  misc_feature (123624)..(123624): n is a, c, g, or t
  misc_feature (123698)..(123698): n is a, c, g, or t
  misc_feature (124163)..(124163): n is a, c, g, or t
  misc_feature (124284)..(124284): n is a, c, g, or t
  misc_feature (124324)..(124324): n is a, c, g, or t
  misc_feature (124327)..(124327): n is a, c, g, or t
  misc_feature (124510)..(124513): n is a, c, g, or t
  misc_feature (124554)..(124554): n is a, c, g, or t
  misc_feature (124556)..(124559): n is a, c, g, or t
  misc_feature (124561)..(124565): n is a, c, g, or t
  misc_feature (124567)..(124568): n is a, c, g, or t
  misc_feature (124570)..(124576): n is a, c, g, or t
  misc_feature (124579)..(124580): n is a, c, g, or t
  misc_feature (124682)..(124682): n is a, c, g, or t
  misc_feature (124697)..(124697): n is a, c, g, or t
  misc_feature (124707)..(124707): n is a, c, g, or t
  misc_feature (124759)..(124759): n is a, c, g, or t
  misc_feature (124783)..(124783): n is a, c, g, or t
  misc_feature (124950)..(124950): n is a, c, g, or t
  misc_feature (125112)..(125112): n is a, c, g, or t
  misc_feature (125405)..(125405): n is a, c, g, or t
  misc_feature (125900)..(125900): n is a, c, g, or t
  misc_feature (126162)..(126162): n is a, c, g, or t
  misc_feature (126561)..(126561): n is a, c, g, or t
  misc_feature (126675)..(126675): n is a, c, g, or t
  misc_feature (126745)..(126745): n is a, c, g, or t
  misc_feature (127227)..(127227): n is a, c, g, or t
  misc_feature (127229)..(127229): n is a, c, g, or t
  misc_feature (127245)..(127245): n is a, c, g, or t
  misc_feature (127542)..(127542): n is a, c, g, or t
  misc_feature (127546)..(127546): n is a, c, g, or t
  misc_feature (127564)..(127564): n is a, c, g, or t
  misc_feature (127616)..(127617): n is a, c, g, or t
  misc_feature (127623)..(127623): n is a, c, g, or t
  misc_feature (127627)..(127627): n is a, c, g, or t
  misc_feature (127636)..(127636): n is a, c, g, or t
  misc_feature (127638)..(127638): n is a, c, g, or t
  misc_feature (127646)..(127646): n is a, c, g, or t
  misc_feature (127690)..(127690): n is a, c, g, or t
  misc_feature (127694)..(127694): n is a, c, g, or t
  misc_feature (127748)..(127748): n is a, c, g, or t
  misc_feature (127929)..(127933): n is a, c, g, or t
  misc_feature (127936)..(127938): n is a, c, g, or t
  misc_feature (127940)..(127941): n is a, c, g, or t
  misc_feature (127943)..(127943): n is a, c, g, or t
  misc_feature (127945)..(127946): n is a, c, g, or t
  misc_feature (127948)..(127948): n is a, c, g, or t
  misc_feature (127950)..(127951): n is a, c, g, or t
  misc_feature (127953)..(127955): n is a, c, g, or t
  misc_feature (127998)..(127999): n is a, c, g, or t
  misc_feature (128040)..(128040): n is a, c, g, or t
  misc_feature (128792)..(128792): n is a, c, g, or t
  misc_feature (128805)..(128805): n is a, c, g, or t
  misc_feature (128822)..(128822): n is a, c, g, or t
  misc_feature (128826)..(128826): n is a, c, g, or t
  misc_feature (128831)..(128831): n is a, c, g, or t
  misc_feature (128840)..(128840): n is a, c, g, or t
  misc_feature (128846)..(128849): n is a, c, g, or t
  misc_feature (128852)..(128852): n is a, c, g, or t
  misc_feature (128854)..(128854): n is a, c, g, or t
  misc_feature (128856)..(128856): n is a, c, g, or t
  misc_feature (128858)..(128859): n is a, c, g, or t
  misc_feature (128861)..(128866): n is a, c, g, or t
  misc_feature (128868)..(128870): n is a, c, g, or t
  misc_feature (128872)..(128883): n is a, c, g, or t
  misc_feature (128887)..(128892): n is a, c, g, or t
  misc_feature (128900)..(129003): n is a, c, g, or t
  misc_feature (129005)..(129007): n is a, c, g, or t
  misc_feature (129009)..(129009): n is a, c, g, or t
  misc_feature (129013)..(129023): n is a, c, g, or t
  misc_feature (129025)..(129026): n is a, c, g, or t
  misc_feature (129029)..(129034): n is a, c, g, or t
  misc_feature (129036)..(129037): n is a, c, g, or t
  misc_feature (129039)..(129045): n is a, c, g, or t
  misc_feature (129049)..(129049): n is a, c, g, or t
  misc_feature (129052)..(129052): n is a, c, g, or t
  misc_feature (129059)..(129059): n is a, c, g, or t
  misc_feature (129070)..(129072): n is a, c, g, or t
  misc_feature (129112)..(129112): n is a, c, g, or t
  misc_feature (129953)..(129953): n is a, c, g, or t
  misc_feature (130252)..(130252): n is a, c, g, or t
  misc_feature (130310)..(130310): n is a, c, g, or t
  misc_feature (130331)..(130331): n is a, c, g, or t
  misc_feature (130357)..(130357): n is a, c, g, or t
  misc_feature (130583)..(130583): n is a, c, g, or t
  misc_feature (130622)..(130622): n is a, c, g, or t
  misc_feature (130949)..(130949): n is a, c, g, or t
  misc_feature (131027)..(131027): n is a, c, g, or t
  misc_feature (131176)..(131176): n is a, c, g, or t
  misc_feature (131374)..(131374): n is a, c, g, or t
  misc_feature (131398)..(131398): n is a, c, g, or t
  misc_feature (131457)..(131457): n is a, c, g, or t
  misc_feature (131682)..(131682): n is a, c, g, or t
  misc_feature (131856)..(131856): n is a, c, g, or t
  misc_feature (132172)..(132172): n is a, c, g, or t
  misc_feature (132216)..(132216): n is a, c, g, or t
  misc_feature (132255)..(132255): n is a, c, g, or t
  misc_feature (132261)..(132261): n is a, c, g, or t
  misc_feature (132346)..(132346): n is a, c, g, or t
  misc_feature (132443)..(132443): n is a, c, g, or t
  misc_feature (132454)..(132454): n is a, c, g, or t
  misc_feature (132490)..(132490): n is a, c, g, or t
  misc_feature (132500)..(132500): n is a, c, g, or t
  misc_feature (132923)..(132923): n is a, c, g, or t
  misc_feature (133031)..(133031): n is a, c, g, or t
  misc_feature (133537)..(133537): n is a, c, g, or t
  misc_feature (133626)..(133626): n is a, c, g, or t
  misc_feature (134178)..(134178): n is a, c, g, or t
  misc_feature (134286)..(134286): n is a, c, g, or t
  misc_feature (134463)..(134463): n is a, c, g, or t
  misc_feature (134543)..(134543): n is a, c, g, or t
  misc_feature (134546)..(134546): n is a, c, g, or t
  misc_feature (134672)..(134672): n is a, c, g, or t
  misc_feature (134729)..(134729): n is a, c, g, or t
  misc_feature (134969)..(134969): n is a, c, g, or t
  misc_feature (135188)..(135188): n is a, c, g, or t
  misc_feature (135200)..(135200): n is a, c, g, or t
  misc_feature (135228)..(135228): n is a, c, g, or t
  misc_feature (135485)..(135485): n is a, c, g, or t
  misc_feature (135616)..(135616): n is a, c, g, or t
  misc_feature (135677)..(135677): n is a, c, g, or t
  misc_feature (136264)..(136264): n is a, c, g, or t
  misc_feature (136361)..(136361): n is a, c, g, or t
  misc_feature (136420)..(136420): n is a, c, g, or t
  misc_feature (136501)..(136501): n is a, c, g, or t
  misc_feature (136637)..(136637): n is a, c, g, or t
  misc_feature (136693)..(136693): n is a, c, g, or t
  misc_feature (136913)..(136913): n is a, c, g, or t
  misc_feature (136915)..(136915): n is a, c, g, or t
  misc_feature (136919)..(136919): n is a, c, g, or t
  misc_feature (136929)..(136929): n is a, c, g, or t
  misc_feature (136935)..(136935): n is a, c, g, or t
  misc_feature (136963)..(136963): n is a, c, g, or t
  misc_feature (136965)..(136965): n is a, c, g, or t
  misc_feature (136968)..(136968): n is a, c, g, or t
  misc_feature (137335)..(137335): n is a, c, g, or t
  misc_feature (137442)..(137442): n is a, c, g, or t
  misc_feature (137562)..(137562): n is a, c, g, or t
  misc_feature (137564)..(137564): n is a, c, g, or t
  misc_feature (137568)..(137568): n is a, c, g, or t
  misc_feature (137570)..(137570): n is a, c, g, or t
  misc_feature (137582)..(137582): n is a, c, g, or t
  misc_feature (137726)..(137726): n is a, c, g, or t
  misc_feature (138176)..(138177): n is a, c, g, or t
  misc_feature (138363)..(138363): n is a, c, g, or t
  misc_feature (138520)..(138520): n is a, c, g, or t
  misc_feature (138708)..(138708): n is a, c, g, or t
  misc_feature (139062)..(139062): n is a, c, g, or t
  misc_feature (139170)..(139170): n is a, c, g, or t
  misc_feature (139268)..(139268): n is a, c, g, or t
  misc_feature (139330)..(139330): n is a, c, g, or t
  misc_feature (139397)..(139397): n is a, c, g, or t
  misc_feature (139407)..(139407): n is a, c, g, or t
  misc_feature (139644)..(139644): n is a, c, g, or t
  misc_feature (139750)..(139750): n is a, c, g, or t
  misc_feature (139767)..(139767): n is a, c, g, or t
  misc_feature (140432)..(140432): n is a, c, g, or t
  misc_feature (140518)..(140518): n is a, c, g, or t
  misc_feature (140589)..(140589): n is a, c, g, or t
  misc_feature (140691)..(140691): n is a, c, g, or t
  misc_feature (140706)..(140706): n is a, c, g, or t
  misc_feature (141232)..(141232): n is a, c, g, or t
  misc_feature (141868)..(141868): n is a, c, g, or t
  misc_feature (141926)..(141926): n is a, c, g, or t
  misc_feature (142176)..(142176): n is a, c, g, or t
  misc_feature (142319)..(142319): n is a, c, g, or t
  misc_feature (142408)..(142408): n is a, c, g, or t
  misc_feature (142414)..(142414): n is a, c, g, or t
  misc_feature (142577)..(142577): n is a, c, g, or t
  misc_feature (142744)..(142744): n is a, c, g, or t
  misc_feature (143125)..(143125): n is a, c, g, or t
  misc_feature (143397)..(143397): n is a, c, g, or t
  misc_feature (143611)..(143611): n is a, c, g, or t
  misc_feature (143617)..(143617): n is a, c, g, or t
  misc_feature (143875)..(143875): n is a, c, g, or t
  misc_feature (144036)..(144036): n is a, c, g, or t
  misc_feature (144099)..(144099): n is a, c, g, or t
  misc_feature (144108)..(144108): n is a, c, g, or t
  misc_feature (144292)..(144292): n is a, c, g, or t
  misc_feature (144341)..(144341): n is a, c, g, or t
  misc_feature (144607)..(144607): n is a, c, g, or t
  misc_feature (144609)..(144609): n is a, c, g, or t
  misc_feature (144611)..(144611): n is a, c, g, or t
  misc_feature (144699)..(144699): n is a, c, g, or t
  misc_feature (144886)..(144886): n is a, c, g, or t
  misc_feature (144947)..(144947): n is a, c, g, or t
  misc_feature (144970)..(144970): n is a, c, g, or t
  misc_feature (145041)..(145041): n is a, c, g, or t
  misc_feature (145067)..(145067): n is a, c, g, or t
  misc_feature (145098)..(145098): n is a, c, g, or t
  misc_feature (145101)..(145101): n is a, c, g, or t
  misc_feature (145106)..(145107): n is a, c, g, or t
  misc_feature (145115)..(145115): n is a, c, g, or t
  misc_feature (145125)..(145130): n is a, c, g, or t
  misc_feature (145132)..(145134): n is a, c, g, or t
  misc_feature (145136)..(145138): n is a, c, g, or t
  misc_feature (145140)..(145146): n is a, c, g, or t
  misc_feature (145785)..(145884): n is a, c, g, or t
  misc_feature (145968)..(145968): n is a, c, g, or t
  misc_feature (145972)..(145972): n is a, c, g, or t
  misc_feature (145979)..(145979): n is a, c, g, or t
  misc_feature (146027)..(146027): n is a, c, g, or t
  misc_feature (146038)..(146038): n is a, c, g, or t
  misc_feature (146045)..(146045): n is a, c, g, or t
  misc_feature (146066)..(146066): n is a, c, g, or t
  misc_feature (146088)..(146088): n is a, c, g, or t
  misc_feature (146107)..(146107): n is a, c, g, or t
  misc_feature (146127)..(146127): n is a, c, g, or t
  misc_feature (146131)..(146131): n is a, c, g, or t
  misc_feature (146272)..(146272): n is a, c, g, or t
  misc_feature (146278)..(146278): n is a, c, g, or t
  misc_feature (147060)..(147060): n is a, c, g, or t
  misc_feature (147137)..(147137): n is a, c, g, or t
  misc_feature (147589)..(147589): n is a, c, g, or t
  misc_feature (148047)..(148047): n is a, c, g, or t
  misc_feature (148051)..(148051): n is a, c, g, or t
  misc_feature (148056)..(148056): n is a, c, g, or t
  misc_feature (148145)..(148145): n is a, c, g, or t
  misc_feature (148244)..(148244): n is a, c, g, or t
  misc_feature (148280)..(148280): n is a, c, g, or t
  misc_feature (148289)..(148289): n is a, c, g, or t
  misc_feature (148372)..(148372): n is a, c, g, or t
  misc_feature (148375)..(148375): n is a, c, g, or t
  misc_feature (148378)..(148378): n is a, c, g, or t
  misc_feature (148415)..(148415): n is a, c, g, or t
  misc_feature (148627)..(148627): n is a, c, g, or t
  misc_feature (148670)..(148670): n is a, c, g, or t
  misc_feature (148701)..(148701): n is a, c, g, or t
  misc_feature (148960)..(148960): n is a, c, g, or t
  misc_feature (149242)..(149242): n is a, c, g, or t
  misc_feature (149351)..(149351): n is a, c, g, or t
  misc_feature (149407)..(149407): n is a, c, g, or t
  misc_feature (149515)..(149515): n is a, c, g, or t
  misc_feature (149718)..(149718): n is a, c, g, or t
  misc_feature (149727)..(149727): n is a, c, g, or t
  misc_feature (149734)..(149734): n is a, c, g, or t
  misc_feature (149844)..(149844): n is a, c, g, or t
  misc_feature (149879)..(149879): n is a, c, g, or t
  misc_feature (149882)..(149882): n is a, c, g, or t
  misc_feature (149910)..(149910): n is a, c, g, or t
  misc_feature (150111)..(150111): n is a, c, g, or t
  misc_feature (150209)..(150209): n is a, c, g, or t
  misc_feature (150375)..(150375): n is a, c, g, or t
  misc_feature (150552)..(150552): n is a, c, g, or t
  misc_feature (150598)..(150598): n is a, c, g, or t
  misc_feature (150640)..(150640): n is a, c, g, or t
  misc_feature (151079)..(151079): n is a, c, g, or t
  misc_feature (151727)..(151727): n is a, c, g, or t
  misc_feature (151909)..(151909): n is a, c, g, or t
  misc_feature (152320)..(152320): n is a, c, g, or t
  misc_feature (152358)..(152358): n is a, c, g, or t
  misc_feature (152372)..(152372): n is a, c, g, or t
  misc_feature (152409)..(152409): n is a, c, g, or t
  misc_feature (152426)..(152426): n is a, c, g, or t
  misc_feature (152468)..(152468): n is a, c, g, or t
  misc_feature (152479)..(152479): n is a, c, g, or t
  misc_feature (152481)..(152481): n is a, c, g, or t
  misc_feature (152484)..(152486): n is a, c, g, or t
  misc_feature (152489)..(152500): n is a, c, g, or t
  misc_feature (152502)..(152504): n is a, c, g, or t
  misc_feature (152506)..(152513): n is a, c, g, or t
  misc_feature (152521)..(152521): n is a, c, g, or t
  misc_feature (152539)..(152539): n is a, c, g, or t
  misc_feature (152545)..(152545): n is a, c, g, or t
  misc_feature (152548)..(152548): n is a, c, g, or t
  misc_feature (152550)..(152550): n is a, c, g, or t
  misc_feature (152562)..(152562): n is a, c, g, or t
  misc_feature (152581)..(152581): n is a, c, g, or t
  misc_feature (152584)..(152584): n is a, c, g, or t
  misc_feature (152591)..(152591): n is a, c, g, or t
  misc_feature (152597)..(152597): n is a, c, g, or t
  misc_feature (152602)..(152603): n is a, c, g, or t
  misc_feature (152633)..(152633): n is a, c, g, or t
  misc_feature (152726)..(152728): n is a, c, g, or t
  misc_feature (152730)..(152731): n is a, c, g, or t
  misc_feature (152733)..(152735): n is a, c, g, or t
  misc_feature (152737)..(152739): n is a, c, g, or t
  misc_feature (152741)..(152752): n is a, c, g, or t
  misc_feature (152754)..(152754): n is a, c, g, or t
  misc_feature (152782)..(152782): n is a, c, g, or t
  misc_feature (152803)..(152803): n is a, c, g, or t
  misc_feature (152812)..(152812): n is a, c, g, or t
  misc_feature (152954)..(152954): n is a, c, g, or t
  misc_feature (152959)..(152959): n is a, c, g, or t
  misc_feature (152969)..(152969): n is a, c, g, or t
  misc_feature (152971)..(152971): n is a, c, g, or t
  misc_feature (152974)..(152974): n is a, c, g, or t
  misc_feature (152977)..(152977): n is a, c, g, or t
  misc_feature (152979)..(152979): n is a, c, g, or t
  misc_feature (152996)..(152996): n is a, c, g, or t
  misc_feature (153429)..(153429): n is a, c, g, or t
  misc_feature (153573)..(153573): n is a, c, g, or t
  misc_feature (153598)..(153598): n is a, c, g, or t
  misc_feature (153725)..(153725): n is a, c, g, or t
  misc_feature (153845)..(153845): n is a, c, g, or t
  misc_feature (154070)..(154070): n is a, c, g, or t
  misc_feature (154120)..(154120): n is a, c, g, or t
  misc_feature (154138)..(154138): n is a, c, g, or t
  misc_feature (154162)..(154162): n is a, c, g, or t
  misc_feature (154165)..(154165): n is a, c, g, or t
  misc_feature (154167)..(154167): n is a, c, g, or t
  misc_feature (154551)..(154551): n is a, c, g, or t
  misc_feature (154889)..(154889): n is a, c, g, or t
  misc_feature (154935)..(154935): n is a, c, g, or t
  misc_feature (154940)..(154940): n is a, c, g, or t
  misc_feature (155265)..(155265): n is a, c, g, or t
  misc_feature (155405)..(155405): n is a, c, g, or t
  misc_feature (155415)..(155415): n is a, c, g, or t
  misc_feature (155417)..(155417): n is a, c, g, or t
  misc_feature (155419)..(155419): n is a, c, g, or t
  misc_feature (155426)..(155426): n is a, c, g, or t
  misc_feature (155724)..(155724): n is a, c, g, or t
  misc_feature (155793)..(155793): n is a, c, g, or t
  misc_feature (155803)..(155803): n is a, c, g, or t
  misc_feature (155810)..(155810): n is a, c, g, or t
  misc_feature (155861)..(155861): n is a, c, g, or t
  misc_feature (155998)..(155998): n is a, c, g, or t
  misc_feature (156007)..(156007): n is a, c, g, or t
  misc_feature (156018)..(156018): n is a, c, g, or t
  misc_feature (156036)..(156036): n is a, c, g, or t
  misc_feature (156054)..(156054): n is a, c, g, or t
  misc_feature (156072)..(156072): n is a, c, g, or t
  misc_feature (156115)..(156115): n is a, c, g, or t
  misc_feature (156163)..(156163): n is a, c, g, or t
  misc_feature (156215)..(156215): n is a, c, g, or t
  misc_feature (156282)..(156282): n is a, c, g, or t
  misc_feature (156518)..(156518): n is a, c, g, or t
  misc_feature (156688)..(156688): n is a, c, g, or t
  misc_feature (156724)..(156724): n is a, c, g, or t
  misc_feature (156726)..(156726): n is a, c, g, or t
  misc_feature (157150)..(157150): n is a, c, g, or t
  misc_feature (157194)..(157194): n is a, c, g, or t
  misc_feature (157232)..(157232): n is a, c, g, or t
  misc_feature (157312)..(157312): n is a, c, g, or t
  misc_feature (157413)..(157413): n is a, c, g, or t
  misc_feature (157544)..(157544): n is a, c, g, or t
  misc_feature (157964)..(157964): n is a, c, g, or t
  misc_feature (158151)..(158151): n is a, c, g, or t
  misc_feature (158267)..(158267): n is a, c, g, or t
  misc_feature (158269)..(158269): n is a, c, g, or t
  misc_feature (158296)..(158296): n is a, c, g, or t
  misc_feature (158324)..(158324): n is a, c, g, or t
  misc_feature (158336)..(158337): n is a, c, g, or t
  misc_feature (158993)..(158993): n is a, c, g, or t
  misc_feature (159150)..(159150): n is a, c, g, or t
  misc_feature (159153)..(159153): n is a, c, g, or t
  misc_feature (159162)..(159162): n is a, c, g, or t
  misc_feature (159190)..(159190): n is a, c, g, or t
  misc_feature (159307)..(159307): n is a, c, g, or t
  misc_feature (159714)..(159714): n is a, c, g, or t
  misc_feature (159757)..(159757): n is a, c, g, or t
  misc_feature (159836)..(159836): n is a, c, g, or t
  misc_feature (160051)..(160051): n is a, c, g, or t
  misc_feature (160057)..(160057): n is a, c, g, or t
  misc_feature (160126)..(160126): n is a, c, g, or t
  misc_feature (160183)..(160183): n is a, c, g, or t
  misc_feature (160254)..(160254): n is a, c, g, or t
  misc_feature (161061)..(161061): n is a, c, g, or t
  misc_feature (161312)..(161312): n is a, c, g, or t
  misc_feature (161552)..(161552): n is a, c, g, or t
  misc_feature (161612)..(161612): n is a, c, g, or t
  misc_feature (161689)..(161695): n is a, c, g, or t
  misc_feature (161697)..(161705): n is a, c, g, or t
  misc_feature (161707)..(161707): n is a, c, g, or t
  misc_feature (161709)..(161712): n is a, c, g, or t
  misc_feature (161714)..(161721): n is a, c, g, or t
  misc_feature (161723)..(161723): n is a, c, g, or t
  misc_feature (161725)..(161725): n is a, c, g, or t
  misc_feature (161727)..(161731): n is a, c, g, or t
  misc_feature (161734)..(161734): n is a, c, g, or t
  misc_feature (161736)..(161736): n is a, c, g, or t
  misc_feature (161738)..(161739): n is a, c, g, or t
  misc_feature (161755)..(161755): n is a, c, g, or t
  misc_feature (161759)..(161759): n is a, c, g, or t
  misc_feature (161771)..(161771): n is a, c, g, or t
  misc_feature (161789)..(161789): n is a, c, g, or t
  misc_feature (161828)..(161834): n is a, c, g, or t
  misc_feature (161837)..(161837): n is a, c, g, or t
  misc_feature (161841)..(161844): n is a, c, g, or t
  misc_feature (161852)..(161852): n is a, c, g, or t
  misc_feature (161856)..(161856): n is a, c, g, or t
  misc_feature (161864)..(161864): n is a, c, g, or t
  misc_feature (161868)..(161868): n is a, c, g, or t
  misc_feature (161876)..(161876): n is a, c, g, or t
  misc_feature (161886)..(161886): n is a, c, g, or t
  misc_feature (161891)..(161892): n is a, c, g, or t
  misc_feature (161895)..(161895): n is a, c, g, or t
  misc_feature (161900)..(161900): n is a, c, g, or t
  misc_feature (161905)..(161905): n is a, c, g, or t
  misc_feature (161923)..(161923): n is a, c, g, or t
  misc_feature (161934)..(161934): n is a, c, g, or t
  misc_feature (161946)..(161946): n is a, c, g, or t
  misc_feature (162038)..(162038): n is a, c, g, or t
  misc_feature (162273)..(162273): n is a, c, g, or t
  misc_feature (162725)..(162725): n is a, c, g, or t
  misc_feature (162739)..(162739): n is a, c, g, or t
  misc_feature (162825)..(162825): n is a, c, g, or t
  misc_feature (162992)..(162992): n is a, c, g, or t
  misc_feature (162998)..(162998): n is a, c, g, or t
  misc_feature (163157)..(163157): n is a, c, g, or t
  misc_feature (163163)..(163163): n is a, c, g, or t
  misc_feature (163172)..(163172): n is a, c, g, or t
  misc_feature (163301)..(163301): n is a, c, g, or t
  misc_feature (163717)..(163717): n is a, c, g, or t
  misc_feature (163723)..(163723): n is a, c, g, or t
  misc_feature (163761)..(163761): n is a, c, g, or t
  misc_feature (163791)..(163791): n is a, c, g, or t
  misc_feature (163819)..(163819): n is a, c, g, or t
  misc_feature (164570)..(164570): n is a, c, g, or t
  misc_feature (164656)..(164656): n is a, c, g, or t
  misc_feature (164733)..(164733): n is a, c, g, or t
  misc_feature (164753)..(164753): n is a, c, g, or t
  misc_feature (164820)..(164820): n is a, c, g, or t
  misc_feature (165042)..(165042): n is a, c, g, or t
  misc_feature (165152)..(165152): n is a, c, g, or t
  misc_feature (165174)..(165174): n is a, c, g, or t
  misc_feature (165203)..(165203): n is a, c, g, or t
  misc_feature (165527)..(165527): n is a, c, g, or t
  misc_feature (165824)..(165824): n is a, c, g, or t
  misc_feature (166208)..(166208): n is a, c, g, or t
  misc_feature (166276)..(166276): n is a, c, g, or t
  misc_feature (166516)..(166516): n is a, c, g, or t
  misc_feature (166520)..(166520): n is a, c, g, or t
  misc_feature (166764)..(166764): n is a, c, g, or t
  misc_feature (166776)..(166776): n is a, c, g, or t
  misc_feature (166957)..(166957): n is a, c, g, or t
  misc_feature (167199)..(167199): n is a, c, g, or t
  misc_feature (167240)..(167240): n is a, c, g, or t
  misc_feature (167242)..(167242): n is a, c, g, or t
  misc_feature (167251)..(167251): n is a, c, g, or t
  misc_feature (167269)..(167269): n is a, c, g, or t
  misc_feature (167297)..(167297): n is a, c, g, or t
  misc_feature (167464)..(167464): n is a, c, g, or t
  misc_feature (167545)..(167545): n is a, c, g, or t
  misc_feature (167709)..(167709): n is a, c, g, or t
  misc_feature (167743)..(167743): n is a, c, g, or t
  misc_feature (167753)..(167753): n is a, c, g, or t
  misc_feature (167926)..(167926): n is a, c, g, or t
  misc_feature (168188)..(168188): n is a, c, g, or t
  misc_feature (168386)..(168386): n is a, c, g, or t
  misc_feature (168402)..(168402): n is a, c, g, or t
  misc_feature (168405)..(168405): n is a, c, g, or t
  misc_feature (168409)..(168409): n is a, c, g, or t
  misc_feature (168412)..(168412): n is a, c, g, or t
  misc_feature (168531)..(168531): n is a, c, g, or t
  misc_feature (168567)..(168567): n is a, c, g, or t
  misc_feature (168574)..(168574): n is a, c, g, or t
  misc_feature (168647)..(168647): n is a, c, g, or t
  misc_feature (168745)..(168745): n is a, c, g, or t
  misc_feature (168751)..(168751): n is a, c, g, or t
  misc_feature (168761)..(168761): n is a, c, g, or t
  misc_feature (168813)..(168813): n is a, c, g, or t
  misc_feature (168876)..(168876): n is a, c, g, or t
  misc_feature (168916)..(168916): n is a, c, g, or t
  misc_feature (169082)..(169082): n is a, c, g, or t
  misc_feature (169108)..(169108): n is a, c, g, or t
  misc_feature (169122)..(169122): n is a, c, g, or t
  misc_feature (169130)..(169130): n is a, c, g, or t
  misc_feature (169456)..(169456): n is a, c, g, or t
  misc_feature (169774)..(169774): n is a, c, g, or t
  misc_feature (169780)..(169780): n is a, c, g, or t
  misc_feature (169787)..(169787): n is a, c, g, or t
  misc_feature (169951)..(169951): n is a, c, g, or t
  misc_feature (169953)..(169953): n is a, c, g, or t
  misc_feature (169984)..(169984): n is a, c, g, or t
  misc_feature (169986)..(169986): n is a, c, g, or t
  misc_feature (170630)..(170630): n is a, c, g, or t
  misc_feature (170648)..(170648): n is a, c, g, or t
  misc_feature (170856)..(170856): n is a, c, g, or t
  misc_feature (170887)..(170887): n is a, c, g, or t
  misc_feature (170985)..(170985): n is a, c, g, or t
  misc_feature (171197)..(171197): n is a, c, g, or t
  misc_feature (171199)..(171201): n is a, c, g, or t
  misc_feature (171203)..(171204): n is a, c, g, or t
  misc_feature (171614)..(171614): n is a, c, g, or t
  misc_feature (171848)..(171848): n is a, c, g, or t
  misc_feature (172112)..(172112): n is a, c, g, or t
  misc_feature (172127)..(172127): n is a, c, g, or t
  misc_feature (172199)..(172199): n is a, c, g, or t
  misc_feature (172206)..(172206): n is a, c, g, or t
  misc_feature (172388)..(172388): n is a, c, g, or t
  misc_feature (172485)..(172485): n is a, c, g, or t
  misc_feature (172669)..(172669): n is a, c, g, or t
  misc_feature (172796)..(172796): n is a, c, g, or t
  misc_feature (173719)..(173719): n is a, c, g, or t
  misc_feature (173733)..(173733): n is a, c, g, or t
  misc_feature (173807)..(173807): n is a, c, g, or t
  misc_feature (174113)..(174113): n is a, c, g, or t
  misc_feature (174180)..(174180): n is a, c, g, or t
  misc_feature (174346)..(174346): n is a, c, g, or t
  misc_feature (174537)..(174537): n is a, c, g, or t
  misc_feature (174543)..(174543): n is a, c, g, or t
  misc_feature (174549)..(174549): n is a, c, g, or t
  misc_feature (174558)..(174558): n is a, c, g, or t
  misc_feature (174640)..(174640): n is a, c, g, or t
  misc_feature (174716)..(174716): n is a, c, g, or t
  misc_feature (174786)..(174786): n is a, c, g, or t
  misc_feature (174831)..(174831): n is a, c, g, or t
  misc_feature (175050)..(175050): n is a, c, g, or t
  misc_feature (175054)..(175054): n is a, c, g, or t
  misc_feature (175071)..(175071): n is a, c, g, or t
  misc_feature (175074)..(175074): n is a, c, g, or t
  misc_feature (175099)..(175099): n is a, c, g, or t
  misc_feature (175107)..(175107): n is a, c, g, or t
  misc_feature (175112)..(175112): n is a, c, g, or t
  misc_feature (175115)..(175115): n is a, c, g, or t
  misc_feature (175117)..(175117): n is a, c, g, or t
  misc_feature (175121)..(175121): n is a, c, g, or t
  misc_feature (175123)..(175124): n is a, c, g, or t
  misc_feature (175126)..(175130): n is a, c, g, or t
  misc_feature (175132)..(175134): n is a, c, g, or t
  misc_feature (175136)..(175137): n is a, c, g, or t
  misc_feature (175140)..(175141): n is a, c, g, or t
  misc_feature (175143)..(175148): n is a, c, g, or t
  misc_feature (175150)..(175150): n is a, c, g, or t
  misc_feature (175152)..(175153): n is a, c, g, or t
  misc_feature (175155)..(175155): n is a, c, g, or t
  misc_feature (175157)..(175168): n is a, c, g, or t
  misc_feature (175170)..(175172): n is a, c, g, or t
  misc_feature (175174)..(175176): n is a, c, g, or t
  misc_feature (175178)..(175178): n is a, c, g, or t
  misc_feature (175180)..(175184): n is a, c, g, or t
  misc_feature (175186)..(175195): n is a, c, g, or t
  misc_feature (175197)..(175197): n is a, c, g, or t
  misc_feature (175199)..(175200): n is a, c, g, or t
  misc_feature (175202)..(175206): n is a, c, g, or t
  misc_feature (175208)..(175209): n is a, c, g, or t
  misc_feature (175212)..(175213): n is a, c, g, or t
  misc_feature (175215)..(175219): n is a, c, g, or t
  misc_feature (175221)..(175223): n is a, c, g, or t
  misc_feature (175226)..(175226): n is a, c, g, or t
  misc_feature (175229)..(175229): n is a, c, g, or t
  misc_feature (175231)..(175231): n is a, c, g, or t
  misc_feature (175234)..(175241): n is a, c, g, or t
  misc_feature (175243)..(175244): n is a, c, g, or t
  misc_feature (175246)..(175249): n is a, c, g, or t
  misc_feature (175251)..(175252): n is a, c, g, or t
  misc_feature (175254)..(175256): n is a, c, g, or t
  misc_feature (175258)..(175261): n is a, c, g, or t
  misc_feature (175263)..(175263): n is a, c, g, or t
  misc_feature (175266)..(175266): n is a, c, g, or t
  misc_feature (175268)..(175268): n is a, c, g, or t
  misc_feature (175270)..(175276): n is a, c, g, or t
  misc_feature (175278)..(175279): n is a, c, g, or t
  misc_feature (175282)..(175282): n is a, c, g, or t
  misc_feature (175284)..(175284): n is a, c, g, or t
  misc_feature (175287)..(175289): n is a, c, g, or t
  misc_feature (175291)..(175292): n is a, c, g, or t
  misc_feature (175295)..(175298): n is a, c, g, or t
  misc_feature (175300)..(175303): n is a, c, g, or t
  misc_feature (175307)..(175310): n is a, c, g, or t
  misc_feature (175312)..(175413): n is a, c, g, or t
  misc_feature (176022)..(176024): n is a, c, g, or t
  misc_feature (176026)..(176026): n is a, c, g, or t
  misc_feature (176028)..(176029): n is a, c, g, or t
  misc_feature (176031)..(176037): n is a, c, g, or t
  misc_feature (176039)..(176041): n is a, c, g, or t
  misc_feature (176043)..(176043): n is a, c, g, or t
  misc_feature (176048)..(176049): n is a, c, g, or t
  misc_feature (176057)..(176057): n is a, c, g, or t
  misc_feature (176070)..(176070): n is a, c, g, or t
  misc_feature (176084)..(176085): n is a, c, g, or t
  misc_feature (176095)..(176095): n is a, c, g, or t
  misc_feature (176199)..(176199): n is a, c, g, or t
  misc_feature (176853)..(176853): n is a, c, g, or t
  misc_feature (176882)..(176882): n is a, c, g, or t
  misc_feature (176896)..(176896): n is a, c, g, or t
  misc_feature (176906)..(176906): n is a, c, g, or t
  misc_feature (176909)..(176909): n is a, c, g, or t
  misc_feature (177076)..(177076): n is a, c, g, or t
  misc_feature (177291)..(177291): n is a, c, g, or t
  misc_feature (177376)..(177376): n is a, c, g, or t
  misc_feature (177378)..(177378): n is a, c, g, or t
  misc_feature (177383)..(177383): n is a, c, g, or t
  misc_feature (177407)..(177407): n is a, c, g, or t
  misc_feature (177410)..(177410): n is a, c, g, or t
  misc_feature (177449)..(177450): n is a, c, g, or t
  misc_feature (178024)..(178024): n is a, c, g, or t
  misc_feature (178175)..(178175): n is a, c, g, or t
  misc_feature (178248)..(178248): n is a, c, g, or t
  misc_feature (178257)..(178257): n is a, c, g, or t
  misc_feature (178366)..(178366): n is a, c, g, or t
  misc_feature (178487)..(178487): n is a, c, g, or t
  misc_feature (178568)..(178568): n is a, c, g, or t
  misc_feature (178698)..(178698): n is a, c, g, or t
  misc_feature (178899)..(178899): n is a, c, g, or t
  misc_feature (179327)..(179327): n is a, c, g, or t
  misc_feature (179469)..(179469): n is a, c, g, or t
  misc_feature (179756)..(179756): n is a, c, g, or t
  misc_feature (179955)..(179955): n is a, c, g, or t
  misc_feature (179984)..(179984): n is a, c, g, or t
  misc_feature (179993)..(179993): n is a, c, g, or t
  misc_feature (179996)..(179996): n is a, c, g, or t
  misc_feature (180053)..(180053): n is a, c, g, or t
  misc_feature (180178)..(180178): n is a, c, g, or t
  misc_feature (180220)..(180220): n is a, c, g, or t
  misc_feature (180691)..(180691): n is a, c, g, or t
  misc_feature (180697)..(180697): n is a, c, g, or t
  misc_feature (180739)..(180739): n is a, c, g, or t
  misc_feature (181085)..(181085): n is a, c, g, or t
  misc_feature (181212)..(181212): n is a, c, g, or t
  misc_feature (181253)..(181253): n is a, c, g, or t
  misc_feature (181259)..(181259): n is a, c, g, or t
  misc_feature (181370)..(181370): n is a, c, g, or t
  misc_feature (182343)..(182343): n is a, c, g, or t
  misc_feature (182448)..(182449): n is a, c, g, or t
  misc_feature (182451)..(182451): n is a, c, g, or t
  misc_feature (182455)..(182455): n is a, c, g, or t
  misc_feature (182457)..(182457): n is a, c, g, or t
  misc_feature (182468)..(182470): n is a, c, g, or t
  misc_feature (182552)..(182552): n is a, c, g, or t
  misc_feature (182554)..(182554): n is a, c, g, or t
  misc_feature (182559)..(182559): n is a, c, g, or t
  misc_feature (182564)..(182565): n is a, c, g, or t
  misc_feature (182576)..(182576): n is a, c, g, or t
  misc_feature (182578)..(182578): n is a, c, g, or t
  misc_feature (182600)..(182600): n is a, c, g, or t
  misc_feature (182602)..(182602): n is a, c, g, or t
  misc_feature (182611)..(182611): n is a, c, g, or t
  misc_feature (182633)..(182634): n is a, c, g, or t
  misc_feature (182636)..(182636): n is a, c, g, or t
  misc_feature (182639)..(182639): n is a, c, g, or t
  misc_feature (182641)..(182641): n is a, c, g, or t
  misc_feature (182653)..(182653): n is a, c, g, or t
  misc_feature (182670)..(182670): n is a, c, g, or t
  misc_feature (182688)..(182688): n is a, c, g, or t
  misc_feature (183022)..(183022): n is a, c, g, or t
  misc_feature (183026)..(183026): n is a, c, g, or t
  misc_feature (183028)..(183028): n is a, c, g, or t
  misc_feature (183032)..(183032): n is a, c, g, or t
  misc_feature (183075)..(183075): n is a, c, g, or t
  misc_feature (183087)..(183087): n is a, c, g, or t
  misc_feature (183089)..(183089): n is a, c, g, or t
  misc_feature (183099)..(183099): n is a, c, g, or t
  misc_feature (183172)..(183172): n is a, c, g, or t
  misc_feature (183218)..(183218): n is a, c, g, or t
  misc_feature (183247)..(183247): n is a, c, g, or t
  misc_feature (183249)..(183249): n is a, c, g, or t
  misc_feature (183364)..(183364): n is a, c, g, or t
  misc_feature (183372)..(183372): n is a, c, g, or t
  misc_feature (183524)..(183524): n is a, c, g, or t
  misc_feature (183649)..(183649): n is a, c, g, or t
  misc_feature (183860)..(183860): n is a, c, g, or t
  misc_feature (183921)..(183921): n is a, c, g, or t
  misc_feature (184149)..(184149): n is a, c, g, or t
  misc_feature (184272)..(184272): n is a, c, g, or t
  misc_feature (184496)..(184496): n is a, c, g, or t
  misc_feature (184499)..(184499): n is a, c, g, or t
  misc_feature (184528)..(184528): n is a, c, g, or t
  misc_feature (184612)..(184612): n is a, c, g, or t
  misc_feature (184697)..(184697): n is a, c, g, or t
  misc_feature (184700)..(184700): n is a, c, g, or t
  misc_feature (184702)..(184702): n is a, c, g, or t
  misc_feature (185111)..(185111): n is a, c, g, or t
  misc_feature (185117)..(185117): n is a, c, g, or t
  misc_feature (185119)..(185119): n is a, c, g, or t
  misc_feature (185141)..(185141): n is a, c, g, or t
  misc_feature (185208)..(185208): n is a, c, g, or t
  misc_feature (185285)..(185285): n is a, c, g, or t
  misc_feature (185408)..(185408): n is a, c, g, or t
  misc_feature (185695)..(185695): n is a, c, g, or t
  misc_feature (185710)..(185710): n is a, c, g, or t
  misc_feature (185764)..(185764): n is a, c, g, or t
  misc_feature (185784)..(185784): n is a, c, g, or t
  misc_feature (185790)..(185790): n is a, c, g, or t
  misc_feature (186244)..(186244): n is a, c, g, or t
  misc_feature (186489)..(186489): n is a, c, g, or t
  misc_feature (186529)..(186529): n is a, c, g, or t
  misc_feature (186679)..(186679): n is a, c, g, or t
  misc_feature (186714)..(186714): n is a, c, g, or t
  misc_feature (186813)..(186813): n is a, c, g, or t
  misc_feature (186972)..(186972): n is a, c, g, or t
  misc_feature (187080)..(187080): n is a, c, g, or t
  misc_feature (187518)..(187518): n is a, c, g, or t
  misc_feature (187550)..(187550): n is a, c, g, or t
  misc_feature (187700)..(187700): n is a, c, g, or t
  misc_feature (187820)..(187820): n is a, c, g, or t
  misc_feature (187828)..(187828): n is a, c, g, or t
  misc_feature (188004)..(188004): n is a, c, g, or t
  misc_feature (188081)..(188081): n is a, c, g, or t
  misc_feature (188157)..(188157): n is a, c, g, or t
  misc_feature (188185)..(188185): n is a, c, g, or t
  misc_feature (188187)..(188187): n is a, c, g, or t
  misc_feature (188284)..(188284): n is a, c, g, or t
  misc_feature (188454)..(188454): n is a, c, g, or t
  misc_feature (188534)..(188534): n is a, c, g, or t
  misc_feature (188558)..(188558): n is a, c, g, or t
  misc_feature (188885)..(188885): n is a, c, g, or t
  misc_feature (189160)..(189160): n is a, c, g, or t
  misc_feature (189239)..(189239): n is a, c, g, or t
  misc_feature (189284)..(189284): n is a, c, g, or t
  misc_feature (189345)..(189345): n is a, c, g, or t
  misc_feature (189359)..(189359): n is a, c, g, or t
  misc_feature (189362)..(189362): n is a, c, g, or t
  misc_feature (189368)..(189368): n is a, c, g, or t
  misc_feature (189405)..(189405): n is a, c, g, or t
  misc_feature (189497)..(189497): n is a, c, g, or t
  misc_feature (189638)..(189638): n is a, c, g, or t
  misc_feature (190036)..(190037): n is a, c, g, or t
  misc_feature (190049)..(190049): n is a, c, g, or t
  misc_feature (190550)..(190550): n is a, c, g, or t
  misc_feature (190553)..(190553): n is a, c, g, or t
  misc_feature (190556)..(190556): n is a, c, g, or t
  misc_feature (191432)..(191432): n is a, c, g, or t
  misc_feature (191434)..(191434): n is a, c, g, or t
  misc_feature (191440)..(191440): n is a, c, g, or t
  misc_feature (191547)..(191547): n is a, c, g, or t
  misc_feature (191889)..(191889): n is a, c, g, or t
  misc_feature (191934)..(191934): n is a, c, g, or t
  misc_feature (192455)..(192455): n is a, c, g, or t
  misc_feature (192703)..(192703): n is a, c, g, or t
  misc_feature (193188)..(193188): n is a, c, g, or t
  misc_feature (193194)..(193194): n is a, c, g, or t
  misc_feature (193304)..(193304): n is a, c, g, or t
  misc_feature (193878)..(193878): n is a, c, g, or t
  misc_feature (193948)..(193948): n is a, c, g, or t
  misc_feature (194144)..(194144): n is a, c, g, or t
  misc_feature (194586)..(194586): n is a, c, g, or t
  misc_feature (194730)..(194730): n is a, c, g, or t
  misc_feature (194766)..(194766): n is a, c, g, or t
  misc_feature (194851)..(194851): n is a, c, g, or t
  misc_feature (194861)..(194861): n is a, c, g, or t
  misc_feature (195307)..(195307): n is a, c, g, or t
  misc_feature (195418)..(195418): n is a, c, g, or t
  misc_feature (195623)..(195623): n is a, c, g, or t
  misc_feature (195658)..(195658): n is a, c, g, or t
  misc_feature (195733)..(195733): n is a, c, g, or t
  misc_feature (195788)..(195788): n is a, c, g, or t
  misc_feature (196002)..(196002): n is a, c, g, or t
  misc_feature (196018)..(196018): n is a, c, g, or t
  misc_feature (196591)..(196591): n is a, c, g, or t
  misc_feature (196604)..(196604): n is a, c, g, or t
  misc_feature (196630)..(196630): n is a, c, g, or t
  misc_feature (196867)..(196867): n is a, c, g, or t
  misc_feature (196870)..(196871): n is a, c, g, or t
  misc_feature (196875)..(196877): n is a, c, g, or t
  misc_feature (196880)..(196880): n is a, c, g, or t
  misc_feature (196882)..(196882): n is a, c, g, or t
  misc_feature (196911)..(196911): n is a, c, g, or t
  misc_feature (196914)..(196914): n is a, c, g, or t
  misc_feature (196931)..(196931): n is a, c, g, or t
  misc_feature (196944)..(196945): n is a, c, g, or t
  misc_feature (196961)..(196961): n is a, c, g, or t
  misc_feature (196965)..(196965): n is a, c, g, or t
  misc_feature (197137)..(197137): n is a, c, g, or t
  misc_feature (197749)..(197749): n is a, c, g, or t
  misc_feature (198168)..(198168): n is a, c, g, or t
  misc_feature (198360)..(198360): n is a, c, g, or t
  misc_feature (198656)..(198656): n is a, c, g, or t
  misc_feature (198684)..(198684): n is a, c, g, or t
  misc_feature (198690)..(198690): n is a, c, g, or t
  misc_feature (198694)..(198694): n is a, c, g, or t
  misc_feature (199304)..(199304): n is a, c, g, or t
  misc_feature (199677)..(199677): n is a, c, g, or t
  misc_feature (199833)..(199833): n is a, c, g, or t
  misc_feature (199835)..(199835): n is a, c, g, or t
  misc_feature (199951)..(199951): n is a, c, g, or t
  misc_feature (200234)..(200234): n is a, c, g, or t
  misc_feature (200595)..(200595): n is a, c, g, or t
  misc_feature (201346)..(201346): n is a, c, g, or t
  misc_feature (201386)..(201386): n is a, c, g, or t
  misc_feature (201416)..(201416): n is a, c, g, or t
  misc_feature (201434)..(201434): n is a, c, g, or t
  misc_feature (201747)..(201747): n is a, c, g, or t
  misc_feature (201795)..(201795): n is a, c, g, or t
  misc_feature (202474)..(202474): n is a, c, g, or t
  misc_feature (202494)..(202494): n is a, c, g, or t
  misc_feature (202610)..(202610): n is a, c, g, or t
  misc_feature (202759)..(202759): n is a, c, g, or t
  misc_feature (202922)..(202922): n is a, c, g, or t
  misc_feature (202926)..(202926): n is a, c, g, or t
  misc_feature (202978)..(202978): n is a, c, g, or t
  misc_feature (203044)..(203044): n is a, c, g, or t
  misc_feature (203497)..(203497): n is a, c, g, or t
  misc_feature (204570)..(204570): n is a, c, g, or t
  misc_feature (204941)..(204941): n is a, c, g, or t
  misc_feature (205084)..(205084): n is a, c, g, or t
  misc_feature (205131)..(205131): n is a, c, g, or t
  misc_feature (205135)..(205135): n is a, c, g, or t
  misc_feature (205295)..(205295): n is a, c, g, or t
  misc_feature (205301)..(205301): n is a, c, g, or t
  misc_feature (205304)..(205304): n is a, c, g, or t
  misc_feature (205310)..(205310): n is a, c, g, or t
  misc_feature (205342)..(205342): n is a, c, g, or t
  misc_feature (205385)..(205385): n is a, c, g, or t
  misc_feature (205397)..(205397): n is a, c, g, or t
  misc_feature (205445)..(205445): n is a, c, g, or t
  misc_feature (205594)..(205594): n is a, c, g, or t
  misc_feature (205687)..(205687): n is a, c, g, or t
  misc_feature (205693)..(205694): n is a, c, g, or t
  misc_feature (205698)..(205698): n is a, c, g, or t
  misc_feature (205961)..(205961): n is a, c, g, or t
  misc_feature (206031)..(206031): n is a, c, g, or t
  misc_feature (206108)..(206108): n is a, c, g, or t
  misc_feature (206154)..(206154): n is a, c, g, or t
  misc_feature (206319)..(206319): n is a, c, g, or t
  misc_feature (206669)..(206669): n is a, c, g, or t
  misc_feature (206787)..(206787): n is a, c, g, or t
  misc_feature (207161)..(207161): n is a, c, g, or t
  misc_feature (207372)..(207372): n is a, c, g, or t
  misc_feature (207397)..(207397): n is a, c, g, or t
  misc_feature (207558)..(207558): n is a, c, g, or t
  misc_feature (207569)..(207569): n is a, c, g, or t
  misc_feature (207831)..(207831): n is a, c, g, or t
  misc_feature (207847)..(207847): n is a, c, g, or t
  misc_feature (207871)..(207871): n is a, c, g, or t
  misc_feature (207878)..(207878): n is a, c, g, or t
  misc_feature (207894)..(207894): n is a, c, g, or t
  misc_feature (208023)..(208023): n is a, c, g, or t
  misc_feature (208124)..(208124): n is a, c, g, or t
  misc_feature (208329)..(208329): n is a, c, g, or t
  misc_feature (208578)..(208578): n is a, c, g, or t
  misc_feature (208612)..(208612): n is a, c, g, or t
  misc_feature (208616)..(208616): n is a, c, g, or t
  misc_feature (208889)..(208889): n is a, c, g, or t
  misc_feature (209152)..(209152): n is a, c, g, or t
  misc_feature (209208)..(209208): n is a, c, g, or t
  misc_feature (209627)..(209627): n is a, c, g, or t
  misc_feature (209728)..(209728): n is a, c, g, or t
  misc_feature (209980)..(209980): n is a, c, g, or t
  misc_feature (210051)..(210051): n is a, c, g, or t
  misc_feature (210170)..(210170): n is a, c, g, or t
  misc_feature (210174)..(210174): n is a, c, g, or t
  misc_feature (210512)..(210512): n is a, c, g, or t
  misc_feature (210630)..(210630): n is a, c, g, or t
  misc_feature (210814)..(210814): n is a, c, g, or t
  misc_feature (211110)..(211110): n is a, c, g, or t
  misc_feature (211497)..(211497): n is a, c, g, or t
  misc_feature (211499)..(211499): n is a, c, g, or t
  misc_feature (211524)..(211524): n is a, c, g, or t
  misc_feature (211663)..(211663): n is a, c, g, or t
  misc_feature (211758)..(211758): n is a, c, g, or t
  misc_feature (211765)..(211765): n is a, c, g, or t
  misc_feature (211768)..(211768): n is a, c, g, or t
  misc_feature (211772)..(211773): n is a, c, g, or t
  misc_feature (211879)..(211879): n is a, c, g, or t
  misc_feature (212031)..(212031): n is a, c, g, or t
  misc_feature (212066)..(212066): n is a, c, g, or t
  misc_feature (212458)..(212458): n is a, c, g, or t
  misc_feature (212482)..(212482): n is a, c, g, or t
  misc_feature (212552)..(212552): n is a, c, g, or t
  misc_feature (212609)..(212609): n is a, c, g, or t
  misc_feature (212700)..(212700): n is a, c, g, or t
  misc_feature (212807)..(212807): n is a, c, g, or t
  misc_feature (212827)..(212828): n is a, c, g, or t
  misc_feature (213100)..(213100): n is a, c, g, or t
  misc_feature (213496)..(213496): n is a, c, g, or t
  misc_feature (213549)..(213549): n is a, c, g, or t
  misc_feature (213553)..(213553): n is a, c, g, or t
  misc_feature (213569)..(213569): n is a, c, g, or t
  misc_feature (213766)..(213766): n is a, c, g, or t
  misc_feature (213779)..(213779): n is a, c, g, or t
  misc_feature (213802)..(213802): n is a, c, g, or t
  misc_feature (213824)..(213824): n is a, c, g, or t
  misc_feature (213834)..(213834): n is a, c, g, or t
  misc_feature (213882)..(213882): n is a, c, g, or t
  misc_feature (213929)..(213929): n is a, c, g, or t
  misc_feature (214019)..(214019): n is a, c, g, or t
  misc_feature (214178)..(214179): n is a, c, g, or t
  misc_feature (214181)..(214184): n is a, c, g, or t
  misc_feature (214186)..(214187): n is a, c, g, or t
  misc_feature (214189)..(214190): n is a, c, g, or t
  misc_feature (214194)..(214194): n is a, c, g, or t
  misc_feature (214196)..(214196): n is a, c, g, or t
  misc_feature (214198)..(214203): n is a, c, g, or t
  misc_feature (214206)..(214211): n is a, c, g, or t
  misc_feature (214213)..(214217): n is a, c, g, or t
  misc_feature (214219)..(214220): n is a, c, g, or t
  misc_feature (214222)..(214225): n is a, c, g, or t
  misc_feature (214227)..(214227): n is a, c, g, or t
  misc_feature (214229)..(214229): n is a, c, g, or t
  misc_feature (214231)..(214234): n is a, c, g, or t
  misc_feature (214236)..(214237): n is a, c, g, or t
  misc_feature (214239)..(214239): n is a, c, g, or t
  misc_feature (214241)..(214241): n is a, c, g, or t
  misc_feature (214244)..(214245): n is a, c, g, or t
  misc_feature (214247)..(214251): n is a, c, g, or t
  misc_feature (214253)..(214255): n is a, c, g, or t
  misc_feature (214257)..(214258): n is a, c, g, or t
  misc_feature (214260)..(214264): n is a, c, g, or t
  misc_feature (214268)..(214269): n is a, c, g, or t
  misc_feature (214272)..(214291): n is a, c, g, or t
  misc_feature (214294)..(214301): n is a, c, g, or t
  misc_feature (214303)..(214306): n is a, c, g, or t
  misc_feature (214309)..(214310): n is a, c, g, or t
  misc_feature (214312)..(214314): n is a, c, g, or t
  misc_feature (214317)..(214331): n is a, c, g, or t
  misc_feature (214333)..(214346): n is a, c, g, or t
  misc_feature (214350)..(214353): n is a, c, g, or t
  misc_feature (214355)..(214355): n is a, c, g, or t
  misc_feature (214358)..(214360): n is a, c, g, or t
  misc_feature (214362)..(214365): n is a, c, g, or t
  misc_feature (214367)..(214368): n is a, c, g, or t
  misc_feature (214370)..(214371): n is a, c, g, or t
  misc_feature (214374)..(214385): n is a, c, g, or t
  misc_feature (214387)..(214392): n is a, c, g, or t
  misc_feature (214394)..(214395): n is a, c, g, or t
  misc_feature (214397)..(214398): n is a, c, g, or t
  misc_feature (214400)..(214400): n is a, c, g, or t
  misc_feature (214402)..(214405): n is a, c, g, or t
  misc_feature (214407)..(214407): n is a, c, g, or t
  misc_feature (214409)..(214410): n is a, c, g, or t
  misc_feature (214412)..(214419): n is a, c, g, or t
  misc_feature (214421)..(214423): n is a, c, g, or t
  misc_feature (214426)..(214430): n is a, c, g, or t
  misc_feature (214432)..(214442): n is a, c, g, or t
  misc_feature (214444)..(214444): n is a, c, g, or t
  misc_feature (214446)..(214460): n is a, c, g, or t
  misc_feature (214463)..(214472): n is a, c, g, or t
  misc_feature (214474)..(214474): n is a, c, g, or t
  misc_feature (214476)..(214476): n is a, c, g, or t
  misc_feature (214478)..(214484): n is a, c, g, or t
  misc_feature (214486)..(214486): n is a, c, g, or t
  misc_feature (214488)..(214494): n is a, c, g, or t
  misc_feature (214497)..(214513): n is a, c, g, or t
  misc_feature (214515)..(214515): n is a, c, g, or t
  misc_feature (214517)..(214522): n is a, c, g, or t
  misc_feature (214524)..(214529): n is a, c, g, or t
  misc_feature (214532)..(214539): n is a, c, g, or t
  misc_feature (214541)..(214558): n is a, c, g, or t
  misc_feature (214560)..(214563): n is a, c, g, or t
  misc_feature (214565)..(214565): n is a, c, g, or t
  misc_feature (214567)..(214569): n is a, c, g, or t
  misc_feature (214571)..(214574): n is a, c, g, or t
  misc_feature (214577)..(214585): n is a, c, g, or t
  misc_feature (214587)..(214591): n is a, c, g, or t
  misc_feature (214594)..(214598): n is a, c, g, or t
  misc_feature (214600)..(214604): n is a, c, g, or t
  misc_feature (214607)..(214609): n is a, c, g, or t
  misc_feature (214611)..(214611): n is a, c, g, or t
  misc_feature (214613)..(214613): n is a, c, g, or t
  misc_feature (214615)..(214618): n is a, c, g, or t
  misc_feature (214620)..(214623): n is a, c, g, or t
  misc_feature (214625)..(214630): n is a, c, g, or t
  misc_feature (214632)..(214635): n is a, c, g, or t
  misc_feature (214639)..(214639): n is a, c, g, or t
  misc_feature (214645)..(214645): n is a, c, g, or t
  misc_feature (214647)..(214648): n is a, c, g, or t
  misc_feature (214650)..(214651): n is a, c, g, or t
  misc_feature (214653)..(214663): n is a, c, g, or t
  misc_feature (214665)..(214666): n is a, c, g, or t
  misc_feature (214669)..(214674): n is a, c, g, or t
  misc_feature (214725)..(214725): n is a, c, g, or t
  misc_feature (214728)..(214728): n is a, c, g, or t
  misc_feature (214763)..(214763): n is a, c, g, or t
  misc_feature (214784)..(214784): n is a, c, g, or t
  misc_feature (214795)..(214795): n is a, c, g, or t
  misc_feature (214877)..(214877): n is a, c, g, or t
  misc_feature (214879)..(214879): n is a, c, g, or t
  misc_feature (214929)..(214942): n is a, c, g, or t
  misc_feature (214944)..(214944): n is a, c, g, or t
  misc_feature (214946)..(214947): n is a, c, g, or t
  misc_feature (214949)..(214954): n is a, c, g, or t
  misc_feature (214957)..(214957): n is a, c, g, or t
  misc_feature (214968)..(214968): n is a, c, g, or t
  misc_feature (214988)..(214988): n is a, c, g, or t
  misc_feature (215086)..(215086): n is a, c, g, or t
  misc_feature (215108)..(215108): n is a, c, g, or t
  misc_feature (215196)..(215196): n is a, c, g, or t
  misc_feature (215219)..(215219): n is a, c, g, or t
  misc_feature (215237)..(215237): n is a, c, g, or t
  misc_feature (215246)..(215246): n is a, c, g, or t
  misc_feature (215341)..(215341): n is a, c, g, or t
  misc_feature (215344)..(215344): n is a, c, g, or t
  misc_feature (215379)..(215379): n is a, c, g, or t
  misc_feature (215395)..(215395): n is a, c, g, or t
  misc_feature (215411)..(215411): n is a, c, g, or t
  misc_feature (215543)..(215543): n is a, c, g, or t
  misc_feature (215551)..(215551): n is a, c, g, or t
  misc_feature (215588)..(215588): n is a, c, g, or t
  misc_feature (215678)..(215678): n is a, c, g, or t
  misc_feature (215685)..(215685): n is a, c, g, or t
  misc_feature (215699)..(215699): n is a, c, g, or t
  misc_feature (215792)..(215792): n is a, c, g, or t
  misc_feature (216239)..(216239): n is a, c, g, or t
  misc_feature (216270)..(216270): n is a, c, g, or t
  misc_feature (216365)..(216365): n is a, c, g, or t
  misc_feature (216388)..(216388): n is a, c, g, or t
  misc_feature (216545)..(216545): n is a, c, g, or t
  misc_feature (216936)..(216936): n is a, c, g, or t
  misc_feature (217042)..(217042): n is a, c, g, or t
  misc_feature (217135)..(217135): n is a, c, g, or t
  misc_feature (217143)..(217144): n is a, c, g, or t
  misc_feature (217166)..(217166): n is a, c, g, or t
  misc_feature (217189)..(217189): n is a, c, g, or t
  misc_feature (217244)..(217244): n is a, c, g, or t
  misc_feature (217570)..(217570): n is a, c, g, or t
  misc_feature (217583)..(217583): n is a, c, g, or t
  misc_feature (217795)..(217795): n is a, c, g, or t
  misc_feature (217877)..(217877): n is a, c, g, or t
  misc_feature (217911)..(217911): n is a, c, g, or t
  misc_feature (218138)..(218138): n is a, c, g, or t
  misc_feature (218173)..(218173): n is a, c, g, or t
  misc_feature (218177)..(218177): n is a, c, g, or t
  misc_feature (218188)..(218188): n is a, c, g, or t
  misc_feature (218238)..(218238): n is a, c, g, or t
  misc_feature (218279)..(218280): n is a, c, g, or t
  misc_feature (218341)..(218341): n is a, c, g, or t
  misc_feature (218365)..(218365): n is a, c, g, or t
  misc_feature (218389)..(218389): n is a, c, g, or t
  misc_feature (218440)..(218440): n is a, c, g, or t
  misc_feature (218476)..(218476): n is a, c, g, or t
  misc_feature (218726)..(218726): n is a, c, g, or t
  misc_feature (218756)..(218756): n is a, c, g, or t
  misc_feature (218784)..(218784): n is a, c, g, or t
  misc_feature (218793)..(218793): n is a, c, g, or t
  misc_feature (218874)..(218874): n is a, c, g, or t
  misc_feature (218891)..(218891): n is a, c, g, or t
  misc_feature (218908)..(218908): n is a, c, g, or t
  misc_feature (218995)..(218995): n is a, c, g, or t
  misc_feature (219002)..(219002): n is a, c, g, or t
  misc_feature (219012)..(219012): n is a, c, g, or t
  misc_feature (219015)..(219015): n is a, c, g, or t
  misc_feature (219018)..(219018): n is a, c, g, or t
  misc_feature (219047)..(219048): n is a, c, g, or t
  misc_feature (219877)..(219877): n is a, c, g, or t
  misc_feature (220054)..(220054): n is a, c, g, or t
  misc_feature (220240)..(220240): n is a, c, g, or t
  misc_feature (220253)..(220253): n is a, c, g, or t
  misc_feature (220255)..(220255): n is a, c, g, or t
  misc_feature (220273)..(220273): n is a, c, g, or t
  misc_feature (220516)..(220516): n is a, c, g, or t
  misc_feature (220549)..(220549): n is a, c, g, or t
  misc_feature (221213)..(221213): n is a, c, g, or t
  misc_feature (221220)..(221220): n is a, c, g, or t
  misc_feature (221225)..(221225): n is a, c, g, or t
  misc_feature (221261)..(221261): n is a, c, g, or t
  misc_feature (221361)..(221361): n is a, c, g, or t
  misc_feature (221723)..(221723): n is a, c, g, or t
  misc_feature (222333)..(222333): n is a, c, g, or t
  misc_feature (222924)..(222924): n is a, c, g, or t
  misc_feature (223205)..(223205): n is a, c, g, or t
  misc_feature (223246)..(223246): n is a, c, g, or t
  misc_feature (223583)..(223583): n is a, c, g, or t
  misc_feature (223998)..(223998): n is a, c, g, or t
  misc_feature (224112)..(224112): n is a, c, g, or t
  misc_feature (224114)..(224115): n is a, c, g, or t
  misc_feature (224120)..(224121): n is a, c, g, or t
  misc_feature (224125)..(224126): n is a, c, g, or t
  misc_feature (224128)..(224130): n is a, c, g, or t
  misc_feature (224132)..(224132): n is a, c, g, or t
  misc_feature (224134)..(224136): n is a, c, g, or t
  misc_feature (224141)..(224142): n is a, c, g, or t
  misc_feature (224488)..(224488): n is a, c, g, or t
  misc_feature (224626)..(224626): n is a, c, g, or t
  misc_feature (224638)..(224638): n is a, c, g, or t
  misc_feature (224642)..(224642): n is a, c, g, or t
  misc_feature (224837)..(224837): n is a, c, g, or t
  misc_feature (225221)..(225221): n is a, c, g, or t
  misc_feature (225387)..(225387): n is a, c, g, or t
  misc_feature (225412)..(225412): n is a, c, g, or t
  misc_feature (225636)..(225636): n is a, c, g, or t
  misc_feature (225766)..(225766): n is a, c, g, or t
  misc_feature (226039)..(226039): n is a, c, g, or t
  misc_feature (226765)..(226765): n is a, c, g, or t
  misc_feature (226964)..(226964): n is a, c, g, or t
  misc_feature (226975)..(226975): n is a, c, g, or t
  misc_feature (227249)..(227249): n is a, c, g, or t
  misc_feature (227345)..(227345): n is a, c, g, or t
  misc_feature (227447)..(227447): n is a, c, g, or t
  misc_feature (227923)..(227923): n is a, c, g, or t
  misc_feature (228074)..(228074): n is a, c, g, or t
  misc_feature (228229)..(228229): n is a, c, g, or t
  misc_feature (228236)..(228236): n is a, c, g, or t
  misc_feature (228264)..(228264): n is a, c, g, or t
  misc_feature (228472)..(228472): n is a, c, g, or t
  misc_feature (229410)..(229410): n is a, c, g, or t
  misc_feature (229553)..(229553): n is a, c, g, or t
  misc_feature (229790)..(229790): n is a, c, g, or t
  misc_feature (230161)..(230161): n is a, c, g, or t
  misc_feature (230163)..(230163): n is a, c, g, or t
  misc_feature (230247)..(230247): n is a, c, g, or t
  misc_feature (230254)..(230254): n is a, c, g, or t
  misc_feature (230258)..(230258): n is a, c, g, or t
  misc_feature (230336)..(230336): n is a, c, g, or t
  misc_feature (230351)..(230351): n is a, c, g, or t
  misc_feature (230526)..(230526): n is a, c, g, or t
  misc_feature (230699)..(230699): n is a, c, g, or t
  misc_feature (230901)..(230901): n is a, c, g, or t
  misc_feature (231166)..(231166): n is a, c, g, or t
  misc_feature (231319)..(231319): n is a, c, g, or t
  misc_feature (231499)..(231499): n is a, c, g, or t
  misc_feature (231641)..(231641): n is a, c, g, or t
  misc_feature (231861)..(231861): n is a, c, g, or t
  misc_feature (232026)..(232026): n is a, c, g, or t
  misc_feature (232165)..(232165): n is a, c, g, or t
  misc_feature (232236)..(232236): n is a, c, g, or t
  misc_feature (232666)..(232666): n is a, c, g, or t
  misc_feature (232669)..(232669): n is a, c, g, or t
  misc_feature (232931)..(232931): n is a, c, g, or t
  misc_feature (232978)..(232978): n is a, c, g, or t
  misc_feature (233004)..(233004): n is a, c, g, or t
  misc_feature (233090)..(233090): n is a, c, g, or t
  misc_feature (233260)..(233260): n is a, c, g, or t
  misc_feature (233271)..(233271): n is a, c, g, or t
  misc_feature (233455)..(233455): n is a, c, g, or t
  misc_feature (233504)..(233504): n is a, c, g, or t
  misc_feature (233850)..(233850): n is a, c, g, or t
  misc_feature (234192)..(234192): n is a, c, g, or t
  misc_feature (234194)..(234194): n is a, c, g, or t
  misc_feature (234199)..(234199): n is a, c, g, or t
  misc_feature (234333)..(234333): n is a, c, g, or t
  misc_feature (234335)..(234335): n is a, c, g, or t
  misc_feature (234338)..(234338): n is a, c, g, or t
  misc_feature (234357)..(234357): n is a, c, g, or t
  misc_feature (234359)..(234359): n is a, c, g, or t
  misc_feature (234362)..(234362): n is a, c, g, or t
  misc_feature (234382)..(234382): n is a, c, g, or t
  misc_feature (234386)..(234386): n is a, c, g, or t
  misc_feature (234397)..(234398): n is a, c, g, or t
  misc_feature (234403)..(234403): n is a, c, g, or t
  misc_feature (234418)..(234418): n is a, c, g, or t
  misc_feature (234423)..(234424): n is a, c, g, or t
  misc_feature (234426)..(234426): n is a, c, g, or t
  misc_feature (234431)..(234432): n is a, c, g, or t
  misc_feature (234435)..(234435): n is a, c, g, or t
  misc_feature (234437)..(234437): n is a, c, g, or t
  misc_feature (234439)..(234440): n is a, c, g, or t
  misc_feature (234450)..(234450): n is a, c, g, or t
  misc_feature (234452)..(234452): n is a, c, g, or t
  misc_feature (234455)..(234455): n is a, c, g, or t
  misc_feature (234458)..(234459): n is a, c, g, or t
  misc_feature (234463)..(234463): n is a, c, g, or t
  misc_feature (234475)..(234477): n is a, c, g, or t
  misc_feature (234479)..(234479): n is a, c, g, or t
  misc_feature (234484)..(234484): n is a, c, g, or t
  misc_feature (234486)..(234486): n is a, c, g, or t
  misc_feature (234491)..(234491): n is a, c, g, or t
  misc_feature (234493)..(234493): n is a, c, g, or t
  misc_feature (234497)..(234498): n is a, c, g, or t
  misc_feature (234500)..(234500): n is a, c, g, or t
  misc_feature (234502)..(234502): n is a, c, g, or t
  misc_feature (234504)..(234511): n is a, c, g, or t
  misc_feature (234513)..(234514): n is a, c, g, or t
  misc_feature (234516)..(234520): n is a, c, g, or t
  misc_feature (234522)..(234523): n is a, c, g, or t
  misc_feature (234525)..(234558): n is a, c, g, or t
  misc_feature (234573)..(234573): n is a, c, g, or t
  misc_feature (234581)..(234582): n is a, c, g, or t
  misc_feature (234586)..(234587): n is a, c, g, or t
  misc_feature (234593)..(234593): n is a, c, g, or t
  misc_feature (234602)..(234602): n is a, c, g, or t
  misc_feature (234604)..(234604): n is a, c, g, or t
  misc_feature (234607)..(234607): n is a, c, g, or t
  misc_feature (234628)..(234629): n is a, c, g, or t
  misc_feature (234640)..(234640): n is a, c, g, or t
  misc_feature (234650)..(234650): n is a, c, g, or t
  misc_feature (234653)..(234653): n is a, c, g, or t
  misc_feature (234659)..(234659): n is a, c, g, or t
  misc_feature (234671)..(234671): n is a, c, g, or t
  misc_feature (234726)..(234726): n is a, c, g, or t
  misc_feature (234759)..(234759): n is a, c, g, or t
  misc_feature (235244)..(235244): n is a, c, g, or t
  misc_feature (235251)..(235251): n is a, c, g, or t
  misc_feature (235277)..(235277): n is a, c, g, or t
  misc_feature (235318)..(235319): n is a, c, g, or t
  misc_feature (235333)..(235333): n is a, c, g, or t
  misc_feature (235335)..(235335): n is a, c, g, or t
  misc_feature (235351)..(235352): n is a, c, g, or t
  misc_feature (235366)..(235366): n is a, c, g, or t
  misc_feature (235373)..(235373): n is a, c, g, or t
  misc_feature (235376)..(235376): n is a, c, g, or t
  misc_feature (235380)..(235380): n is a, c, g, or t
  misc_feature (235385)..(235385): n is a, c, g, or t
  misc_feature (235392)..(235393): n is a, c, g, or t
  misc_feature (235395)..(235398): n is a, c, g, or t
  misc_feature (235400)..(235400): n is a, c, g, or t
  misc_feature (235403)..(235403): n is a, c, g, or t
  misc_feature (235406)..(235407): n is a, c, g, or t
  misc_feature (235409)..(235409): n is a, c, g, or t
  misc_feature (235411)..(235415): n is a, c, g, or t
  misc_feature (235449)..(235449): n is a, c, g, or t
  misc_feature (235541)..(235541): n is a, c, g, or t
  misc_feature (235638)..(235638): n is a, c, g, or t
  misc_feature (235802)..(235802): n is a, c, g, or t
  misc_feature (235829)..(235829): n is a, c, g, or t
  misc_feature (235833)..(235833): n is a, c, g, or t
  misc_feature (236334)..(236334): n is a, c, g, or t
  misc_feature (236339)..(236339): n is a, c, g, or t
  misc_feature (236561)..(236561): n is a, c, g, or t
  misc_feature (236568)..(236568): n is a, c, g, or t
  misc_feature (236575)..(236575): n is a, c, g, or t
  misc_feature (236602)..(236605): n is a, c, g, or t
  misc_feature (236608)..(236612): n is a, c, g, or t
  misc_feature (236614)..(236623): n is a, c, g, or t
  misc_feature (236672)..(236672): n is a, c, g, or t
  misc_feature (236753)..(236753): n is a, c, g, or t
  misc_feature (236756)..(236756): n is a, c, g, or t
  misc_feature (236785)..(236786): n is a, c, g, or t
  misc_feature (236795)..(236795): n is a, c, g, or t
  misc_feature (236812)..(236812): n is a, c, g, or t
  misc_feature (236818)..(236818): n is a, c, g, or t
  misc_feature (237132)..(237132): n is a, c, g, or t
  misc_feature (238100)..(238100): n is a, c, g, or t
  misc_feature (238116)..(238116): n is a, c, g, or t
  misc_feature (238457)..(238457): n is a, c, g, or t
  misc_feature (238534)..(238534): n is a, c, g, or t
  misc_feature (238842)..(238842): n is a, c, g, or t
  misc_feature (238911)..(238911): n is a, c, g, or t
  misc_feature (238971)..(238971): n is a, c, g, or t
  misc_feature (239771)..(239771): n is a, c, g, or t
  misc_feature (239808)..(239808): n is a, c, g, or t
  misc_feature (239876)..(239876): n is a, c, g, or t
  misc_feature (239878)..(239878): n is a, c, g, or t
  misc_feature (239880)..(239880): n is a, c, g, or t
  misc_feature (239900)..(239900): n is a, c, g, or t
  misc_feature (239948)..(239948): n is a, c, g, or t
  misc_feature (240028)..(240028): n is a, c, g, or t
  misc_feature (240031)..(240031): n is a, c, g, or t
  misc_feature (240155)..(240155): n is a, c, g, or t
  misc_feature (240441)..(240441): n is a, c, g, or t
  misc_feature (240443)..(240443): n is a, c, g, or t
  misc_feature (240445)..(240445): n is a, c, g, or t
  misc_feature (240477)..(240477): n is a, c, g, or t
  misc_feature (240484)..(240484): n is a, c, g, or t
  misc_feature (240616)..(240616): n is a, c, g, or t
  misc_feature (240646)..(240646): n is a, c, g, or t
  misc_feature (240748)..(240748): n is a, c, g, or t
  misc_feature (240998)..(240998): n is a, c, g, or t
  misc_feature (241064)..(241064): n is a, c, g, or t
  misc_feature (241071)..(241071): n is a, c, g, or t
  misc_feature (241106)..(241106): n is a, c, g, or t
  misc_feature (241138)..(241138): n is a, c, g, or t
  misc_feature (241279)..(241279): n is a, c, g, or t
  misc_feature (241630)..(241630): n is a, c, g, or t
  misc_feature (241943)..(241943): n is a, c, g, or t
  misc_feature (242083)..(242083): n is a, c, g, or t
  misc_feature (242150)..(242150): n is a, c, g, or t
  misc_feature (242175)..(242175): n is a, c, g, or t
  misc_feature (242213)..(242213): n is a, c, g, or t
  misc_feature (242230)..(242230): n is a, c, g, or t
  misc_feature (242266)..(242266): n is a, c, g, or t
  misc_feature (242468)..(242468): n is a, c, g, or t
  misc_feature (242490)..(242490): n is a, c, g, or t
  misc_feature (242502)..(242502): n is a, c, g, or t
  misc_feature (242623)..(242623): n is a, c, g, or t
  misc_feature (242626)..(242626): n is a, c, g, or t
  misc_feature (242786)..(242786): n is a, c, g, or t
  misc_feature (242802)..(242802): n is a, c, g, or t
  misc_feature (242944)..(242944): n is a, c, g, or t
  misc_feature (242991)..(242991): n is a, c, g, or t
  misc_feature (243126)..(243126): n is a, c, g, or t
  misc_feature (243130)..(243130): n is a, c, g, or t
  misc_feature (243206)..(243206): n is a, c, g, or t
  misc_feature (243381)..(243381): n is a, c, g, or t
  misc_feature (243407)..(243407): n is a, c, g, or t
  misc_feature (243438)..(243438): n is a, c, g, or t
  misc_feature (243473)..(243473): n is a, c, g, or t
  misc_feature (243781)..(243781): n is a, c, g, or t
  misc_feature (243813)..(243813): n is a, c, g, or t
  misc_feature (244068)..(244068): n is a, c, g, or t
  misc_feature (244113)..(244113): n is a, c, g, or t
  misc_feature (245107)..(245107): n is a, c, g, or t
  misc_feature (245664)..(245664): n is a, c, g, or t
  misc_feature (245876)..(245876): n is a, c, g, or t
  misc_feature (246155)..(246155): n is a, c, g, or t
  misc_feature (247006)..(247006): n is a, c, g, or t
  misc_feature (247292)..(247292): n is a, c, g, or t
  misc_feature (247500)..(247500): n is a, c, g, or t
  misc_feature (247655)..(247655): n is a, c, g, or t
  misc_feature (247707)..(247707): n is a, c, g, or t
  misc_feature (247945)..(247945): n is a, c, g, or t
  misc_feature (248150)..(248150): n is a, c, g, or t
  misc_feature (248164)..(248164): n is a, c, g, or t
  misc_feature (248508)..(248508): n is a, c, g, or t
  misc_feature (248512)..(248512): n is a, c, g, or t
  misc_feature (248554)..(248554): n is a, c, g, or t
  misc_feature (248630)..(248630): n is a, c, g, or t
  misc_feature (248633)..(248633): n is a, c, g, or t
  misc_feature (248679)..(248679): n is a, c, g, or t
  misc_feature (248729)..(248729): n is a, c, g, or t
  misc_feature (248983)..(248983): n is a, c, g, or t
  misc_feature (249155)..(249155): n is a, c, g, or t
  misc_feature (249161)..(249161): n is a, c, g, or t
  misc_feature (249163)..(249163): n is a, c, g, or t
  misc_feature (249166)..(249166): n is a, c, g, or t
  misc_feature (249271)..(249271): n is a, c, g, or t
  misc_feature (249355)..(249355): n is a, c, g, or t
  misc_feature (249442)..(249442): n is a, c, g, or t
  misc_feature (249475)..(249475): n is a, c, g, or t
  misc_feature (249640)..(249640): n is a, c, g, or t
  misc_feature (249938)..(249938): n is a, c, g, or t
  misc_feature (250419)..(250419): n is a, c, g, or t
  misc_feature (250705)..(250705): n is a, c, g, or t
  misc_feature (251045)..(251045): n is a, c, g, or t
  misc_feature (251076)..(251076): n is a, c, g, or t
  misc_feature (251151)..(251151): n is a, c, g, or t
  misc_feature (251167)..(251167): n is a, c, g, or t
  misc_feature (251478)..(251478): n is a, c, g, or t
  misc_feature (251567)..(251567): n is a, c, g, or t
  misc_feature (251679)..(251679): n is a, c, g, or t
  misc_feature (251784)..(251784): n is a, c, g, or t
  misc_feature (252429)..(252429): n is a, c, g, or t
  misc_feature (252462)..(252462): n is a, c, g, or t
  misc_feature (252871)..(252871): n is a, c, g, or t
  misc_feature (252874)..(252874): n is a, c, g, or t
  misc_feature (252908)..(252908): n is a, c, g, or t
  misc_feature (252910)..(252910): n is a, c, g, or t
  misc_feature (252932)..(252932): n is a, c, g, or t
  misc_feature (253252)..(253252): n is a, c, g, or t
  misc_feature (253571)..(253571): n is a, c, g, or t
  misc_feature (253703)..(253703): n is a, c, g, or t
  misc_feature (253815)..(253815): n is a, c, g, or t
  misc_feature (253905)..(253905): n is a, c, g, or t
  misc_feature (254334)..(254334): n is a, c, g, or t
  misc_feature (254361)..(254362): n is a, c, g, or t
  misc_feature (254444)..(254444): n is a, c, g, or t
  misc_feature (254465)..(254465): n is a, c, g, or t
  misc_feature (254503)..(254503): n is a, c, g, or t
  misc_feature (254537)..(254537): n is a, c, g, or t
  misc_feature (254552)..(254552): n is a, c, g, or t
  misc_feature (254566)..(254566): n is a, c, g, or t
  misc_feature (254625)..(254625): n is a, c, g, or t
  misc_feature (254627)..(254627): n is a, c, g, or t
  misc_feature (254648)..(254648): n is a, c, g, or t
  misc_feature (254651)..(254651): n is a, c, g, or t
  misc_feature (254655)..(254655): n is a, c, g, or t
  misc_feature (254657)..(254659): n is a, c, g, or t
  misc_feature (254663)..(254663): n is a, c, g, or t
  misc_feature (254665)..(254665): n is a, c, g, or t
  misc_feature (254668)..(254680): n is a, c, g, or t
  misc_feature (254682)..(254682): n is a, c, g, or t
  misc_feature (254684)..(254684): n is a, c, g, or t
  misc_feature (254686)..(254686): n is a, c, g, or t
  misc_feature (254688)..(254693): n is a, c, g, or t
  misc_feature (254695)..(254699): n is a, c, g, or t
  misc_feature (254701)..(254701): n is a, c, g, or t
  misc_feature (254704)..(254705): n is a, c, g, or t
  misc_feature (254707)..(254710): n is a, c, g, or t
  misc_feature (254714)..(254718): n is a, c, g, or t
  misc_feature (254721)..(254724): n is a, c, g, or t
  misc_feature (254728)..(254734): n is a, c, g, or t
  misc_feature (254736)..(254737): n is a, c, g, or t
  misc_feature (254739)..(254740): n is a, c, g, or t
  misc_feature (254742)..(254742): n is a, c, g, or t
  misc_feature (254744)..(254748): n is a, c, g, or t
  misc_feature (254750)..(254753): n is a, c, g, or t
  misc_feature (254755)..(254755): n is a, c, g, or t
  misc_feature (254757)..(254770): n is a, c, g, or t
  misc_feature (254772)..(254772): n is a, c, g, or t
  misc_feature (254774)..(254776): n is a, c, g, or t
  misc_feature (254778)..(254778): n is a, c, g, or t
  misc_feature (254805)..(254805): n is a, c, g, or t
  misc_feature (254832)..(254832): n is a, c, g, or t
  misc_feature (254846)..(254847): n is a, c, g, or t
  misc_feature (254864)..(254864): n is a, c, g, or t
  misc_feature (255091)..(255091): n is a, c, g, or t
  misc_feature (255705)..(255705): n is a, c, g, or t
  misc_feature (255708)..(255708): n is a, c, g, or t
  misc_feature (255711)..(255711): n is a, c, g, or t
  misc_feature (256698)..(256698): n is a, c, g, or t
  misc_feature (256700)..(256700): n is a, c, g, or t
  misc_feature (256745)..(256745): n is a, c, g, or t
  misc_feature (256788)..(256788): n is a, c, g, or t
  misc_feature (256846)..(256846): n is a, c, g, or t
  misc_feature (256949)..(256949): n is a, c, g, or t
  misc_feature (257268)..(257268): n is a, c, g, or t
  misc_feature (257315)..(257315): n is a, c, g, or t
  misc_feature (257317)..(257317): n is a, c, g, or t
  misc_feature (257410)..(257410): n is a, c, g, or t
  misc_feature (257504)..(257504): n is a, c, g, or t
  misc_feature (258055)..(258055): n is a, c, g, or t
  misc_feature (258560)..(258560): n is a, c, g, or t
  misc_feature (258637)..(258637): n is a, c, g, or t
  misc_feature (258974)..(258974): n is a, c, g, or t
  misc_feature (259478)..(259478): n is a, c, g, or t
  misc_feature (259513)..(259513): n is a, c, g, or t
  misc_feature (259518)..(259518): n is a, c, g, or t
  misc_feature (259523)..(259523): n is a, c, g, or t
  misc_feature (259578)..(259578): n is a, c, g, or t
  misc_feature (259582)..(259582): n is a, c, g, or t
  misc_feature (259836)..(259836): n is a, c, g, or t
  misc_feature (260276)..(260276): n is a, c, g, or t
  misc_feature (260371)..(260371): n is a, c, g, or t
  misc_feature (260390)..(260390): n is a, c, g, or t
  misc_feature (260397)..(260397): n is a, c, g, or t
  misc_feature (260484)..(260484): n is a, c, g, or t
  misc_feature (260503)..(260503): n is a, c, g, or t
  misc_feature (260683)..(260683): n is a, c, g, or t
  misc_feature (260736)..(260736): n is a, c, g, or t
  misc_feature (260756)..(260756): n is a, c, g, or t
  misc_feature (261372)..(261372): n is a, c, g, or t
  misc_feature (261908)..(261908): n is a, c, g, or t
  misc_feature (261999)..(261999): n is a, c, g, or t
  misc_feature (262531)..(262531): n is a, c, g, or t
  misc_feature (262535)..(262535): n is a, c, g, or t
  misc_feature (262592)..(262592): n is a, c, g, or t
  misc_feature (262725)..(262725): n is a, c, g, or t
  misc_feature (262848)..(262848): n is a, c, g, or t
  misc_feature (262866)..(262866): n is a, c, g, or t
  misc_feature (262963)..(262963): n is a, c, g, or t
  misc_feature (263245)..(263245): n is a, c, g, or t
  misc_feature (263391)..(263391): n is a, c, g, or t
  misc_feature (263734)..(263734): n is a, c, g, or t
  misc_feature (263867)..(263867): n is a, c, g, or t
  misc_feature (263960)..(263960): n is a, c, g, or t
  misc_feature (263966)..(263966): n is a, c, g, or t
  misc_feature (263974)..(263974): n is a, c, g, or t
  misc_feature (263981)..(263981): n is a, c, g, or t
  misc_feature (264396)..(264396): n is a, c, g, or t
  misc_feature (264540)..(264540): n is a, c, g, or t
  misc_feature (264676)..(264676): n is a, c, g, or t
  misc_feature (264688)..(264688): n is a, c, g, or t
  misc_feature (265175)..(265175): n is a, c, g, or t
  misc_feature (265400)..(265400): n is a, c, g, or t
  misc_feature (265615)..(265615): n is a, c, g, or t
  misc_feature (265678)..(265678): n is a, c, g, or t
  misc_feature (266128)..(266128): n is a, c, g, or t
  misc_feature (266450)..(266451): n is a, c, g, or t
  misc_feature (266454)..(266455): n is a, c, g, or t
  misc_feature (266459)..(266460): n is a, c, g, or t
  misc_feature (266473)..(266473): n is a, c, g, or t
  misc_feature (266482)..(266483): n is a, c, g, or t
  misc_feature (266580)..(266580): n is a, c, g, or t
  misc_feature (266601)..(266601): n is a, c, g, or t
  misc_feature (266960)..(266960): n is a, c, g, or t
  misc_feature (267107)..(267107): n is a, c, g, or t
  misc_feature (267282)..(267282): n is a, c, g, or t
  misc_feature (267325)..(267325): n is a, c, g, or t
  misc_feature (267415)..(267415): n is a, c, g, or t
  misc_feature (267531)..(267531): n is a, c, g, or t
  misc_feature (267777)..(267777): n is a, c, g, or t
  misc_feature (267850)..(267850): n is a, c, g, or t
  misc_feature (267916)..(267916): n is a, c, g, or t
  misc_feature (268023)..(268023): n is a, c, g, or t
  misc_feature (268067)..(268067): n is a, c, g, or t
  misc_feature (268074)..(268074): n is a, c, g, or t
  misc_feature (268084)..(268084): n is a, c, g, or t
  misc_feature (268201)..(268201): n is a, c, g, or t
  misc_feature (268210)..(268210): n is a, c, g, or t
  misc_feature (268217)..(268217): n is a, c, g, or t
  misc_feature (268223)..(268223): n is a, c, g, or t
  misc_feature (268231)..(268231): n is a, c, g, or t
  misc_feature (268236)..(268236): n is a, c, g, or t
  misc_feature (268239)..(268239): n is a, c, g, or t
  misc_feature (268242)..(268242): n is a, c, g, or t
  misc_feature (268255)..(268256): n is a, c, g, or t
  misc_feature (268265)..(268265): n is a, c, g, or t
  misc_feature (268320)..(268320): n is a, c, g, or t
  misc_feature (268680)..(268680): n is a, c, g, or t
  misc_feature (268734)..(268734): n is a, c, g, or t
  misc_feature (268790)..(268790): n is a, c, g, or t
  misc_feature (268799)..(268799): n is a, c, g, or t
  misc_feature (268807)..(268807): n is a, c, g, or t
  misc_feature (268815)..(268815): n is a, c, g, or t
  misc_feature (268859)..(268859): n is a, c, g, or t
  misc_feature (268869)..(268869): n is a, c, g, or t
  misc_feature (269093)..(269093): n is a, c, g, or t
  misc_feature (269184)..(269184): n is a, c, g, or t
  misc_feature (269342)..(269342): n is a, c, g, or t
  misc_feature (270029)..(270029): n is a, c, g, or t
  misc_feature (270280)..(270280): n is a, c, g, or t
  misc_feature (270441)..(270441): n is a, c, g, or t
  misc_feature (270611)..(270611): n is a, c, g, or t
  misc_feature (270706)..(270707): n is a, c, g, or t
  misc_feature (270710)..(270722): n is a, c, g, or t
  misc_feature (270724)..(270728): n is a, c, g, or t
  misc_feature (270730)..(270741): n is a, c, g, or t
  misc_feature (270743)..(270744): n is a, c, g, or t
  misc_feature (270746)..(270752): n is a, c, g, or t
  misc_feature (270754)..(270757): n is a, c, g, or t
  misc_feature (270759)..(270774): n is a, c, g, or t
  misc_feature (270776)..(270782): n is a, c, g, or t
  misc_feature (270784)..(270788): n is a, c, g, or t
  misc_feature (270790)..(270807): n is a, c, g, or t
  misc_feature (270809)..(270809): n is a, c, g, or t
  misc_feature (270811)..(270813): n is a, c, g, or t
  misc_feature (270815)..(270820): n is a, c, g, or t
  misc_feature (270822)..(270824): n is a, c, g, or t
  misc_feature (270826)..(270826): n is a, c, g, or t
  misc_feature (270829)..(270831): n is a, c, g, or t
  misc_feature (270833)..(270834): n is a, c, g, or t
  misc_feature (270836)..(270839): n is a, c, g, or t
  misc_feature (270841)..(270841): n is a, c, g, or t
  misc_feature (270843)..(270846): n is a, c, g, or t
  misc_feature (270849)..(270855): n is a, c, g, or t
  misc_feature (270857)..(270860): n is a, c, g, or t
  misc_feature (270862)..(270862): n is a, c, g, or t
  misc_feature (270864)..(270869): n is a, c, g, or t
  misc_feature (270871)..(270872): n is a, c, g, or t
  misc_feature (270874)..(270878): n is a, c, g, or t
  misc_feature (270881)..(270888): n is a, c, g, or t
  misc_feature (270891)..(270892): n is a, c, g, or t
  misc_feature (270895)..(270899): n is a, c, g, or t
  misc_feature (270902)..(270902): n is a, c, g, or t
  misc_feature (270905)..(270909): n is a, c, g, or t
  misc_feature (270911)..(270914): n is a, c, g, or t
  misc_feature (270916)..(270918): n is a, c, g, or t
  misc_feature (270920)..(270928): n is a, c, g, or t
  misc_feature (270930)..(270934): n is a, c, g, or t
  misc_feature (270936)..(270936): n is a, c, g, or t
  misc_feature (270938)..(270940): n is a, c, g, or t
  misc_feature (270942)..(270942): n is a, c, g, or t
  misc_feature (270944)..(270955): n is a, c, g, or t
  misc_feature (270957)..(270959): n is a, c, g, or t
  misc_feature (270961)..(270965): n is a, c, g, or t
  misc_feature (270967)..(270970): n is a, c, g, or t
  misc_feature (270973)..(270976): n is a, c, g, or t
  misc_feature (270978)..(270983): n is a, c, g, or t
  misc_feature (270985)..(270991): n is a, c, g, or t
  misc_feature (270993)..(270997): n is a, c, g, or t
  misc_feature (270999)..(271000): n is a, c, g, or t
  misc_feature (271002)..(271037): n is a, c, g, or t
  misc_feature (271039)..(271059): n is a, c, g, or t
  misc_feature (271061)..(321060): n is a, c, g, or t
  misc_feature (362062)..(412061): n is a, c, g, or t
  misc_feature (437804)..(438549): n is a, c, g, or t
  misc_feature (439382)..(439481): n is a, c, g, or t
cttagatacacccagtgataacctatggcttcgctatgttccgtgttgatagaaggatccaaaaccttcccgttggccttcaccgtctacttaacgagccacgcccctcctaggacaccgcaagagaaatgctggggtcacccctggccgaggcctccctcctgctggccacacgtaagaaaggacttcacaagggagacctccgtggctgccacacacattcaccccaaatgcttcctggagaaagcacatgccctcacactgtgagctcgtgagtttgccaaaaaggagatgcaggagcctgagatcacctcctgtcttgctgctaaaatatcccagccgtggaaaagcaaggctggcctcaaattggggaatctggtcttgccagcccagctgtgctccagggactccggtttgcattgggaatgagagagtgttggccgggtaagatggcaagacagacacagtcctcctacagacttgtagaagggctttctgcccgcccccacccagggcagaaagaggaggcacaggggaaaacaacaagagccctggccaagaatgagccctctgccgtcgtcctgtgtgtggccttgtggcccagcaccagcgctggggggcactttgccctgcctgacaggaggaagggatgccctagtgaggtgggaaacagagggagaggttgagaccaccttggacaagaagggccagggaaggccctcctcacctgtcactacagcccgacacttagaaggtaccgcctgatttcagcctctgcatccacggtcacctacttagtaccccccataggtaggggttggctcctgcctttcccaggagggaggacagactcaccctgtggccagcagggagcagacacccccaaaagccactggggctgcagggcccccaaagtggaaatgacctgccactctgtccatcccatgggggagaaacaatcagaccctaggcagggggcatttagggcaaacagctggcccacagcacggactctcctctttgcagctaatttttggactgcatgggccacatctgggccctgggacttcccatggagccgcggcaggtagaaggatggaaccccacaatctgaagagcagagaggagcctgatcagaaggagtcttggcttctttattcctccttgacccaccctcttgccaccatccctcactagcaattctccccaaaatcctgctgcagaaatctgccttccaataacattgcctgggcagaagccacaggagcaggagcgctgcctgctggagggtgaccaacaggtgcaggggcctcaggtgccactgcctttacacacgtggccagtacaaaagagcactccaggaggaaggtggtggcaatgcagagatgaccgtgcacatgcacacatgcacacgtgcacacatgcacacacacactcatgcacatgcacacacatacatgcacacatgtgcacacatacatgcacatgtgcgcgcacacacacacatgcacacgcgcacacaccctcctcgttgttaaggaccttaacttagaatgatgtattctctgttctcctggctataattattttagcgtgggagacaaattctgtctccagcatctccgaagtgcaatgttggaaaatcacatcccatggtcctggaagatccctaccttctccagctcttttcctccacagaggagcataaacagacccttccaaggggtgaaccttggaggctttaattcctcctccaagcagctccacgtagagcaacagagacgcagggaccgtgcaagtaaccatggcaactccaggaagtttaaaaaaataagtttttgagttgttgagttgttatttggtgcttagtgggttggactcttgccttcctttttgagataacgaggcctctgaatggtgcttttaatgagctttgtgggtaccgtatggaaggcagcccgtgtccccagaatctcatgacctttgaagggggaagcaagtgtctcatctcagttccacagagtcccaggcaggtctgtcctcagattaggttgctccctgtggggtgatcttgagccagtgtggcccctccccaaccttccacccacccacagaagtgagaagtgctccatgcctccccctccccaggagacccaacatttacaggaactcttacagtgcccagctactctgcaatccagatccaccaggatcccaaatattcatcccaagacacccacgggggcaagtttccacgcacgcatctcctaagtgggggaagagggtcaggctacccctgcgaacatactaatatgctggccagcacgcatgtgtaggtgcacaggagacccgtgcaactccacccccgcacgacacgaccccactgcccacgctcggagattctcagggtcccttgaagggtccagctggccttggtggaggcgaatgggagccgctgtcctggggtcagcccttctctgtgcaggccacagcagcaggtgttctgtgccaaaggtcatcctcgcgtgtgccgatggggtgtacatgtgctcacacaggcacaaaagcacgcacgctgctattcgtgccgtgaccgtgaagccaccgcagcaggccacgtcctgcggctcccaagggcaggctgccttgaccacccactgagcacctccgacagaaccatggcggagccgcagccccccaacaagagtttgttgcaggttggtgccgggagagctgaggagtgcttgggccacagctgcagaggcaaagggctgggctacctggctggggaaaaaggaatattttcttaaagggagaaaaatcctaaatggccctcgcagtctcttggcacacataattgtagtatccaagttaatgaaaggcctggcacatgggctgagtcacagcaaatgcctggccctgcacctcacatgcagcagctcgtagaaatcagacgatggcgggcagggggcagggggggcccaggaaataaagagcatttccaggaatggcaagtctcccacgcgggatcatatcatcaattagccagtgggagggccgaggagtgctggcatctcatttccacaaagacaaagtttccttgaggaaattgccagagtcttcaaggtactgaaataacacacagaacaaatgaagaaggacggccgcagggcttggtggatgctcagaagcccagctcccggcagccttgcagaggggcgtgtgtgtttaaagacacaagtggagcctgcgatgtccaagaggcaagcaccagtaccaatacatgacacacacatgtgctcacacatgtacgacacacatatgctcatgcacgcacacaggtacatgtgggtacacaaatgcagaaacacacttgtgcatgtgcacatacatgcacacacatgcacacatacaggatgcacatgcatgcctgtgtgcacactctacacacaggcacatgcatgtacaatctacacgtgtgcatgtgtgcactgatatgcacgcacctgtgcacacatacatgtgcacaagctctgcttgcaggtgggggtccactatcctgacttccaaacattcaggtttgaggctcttgcaaatgccagataccatggagacaaaacgccctctaaacacattatccagaattttcccttaattccctacagcacatgccccatttgtgaggagacccccggggtcttcaggctctgactctgatggagctcagagtatgtcaaacccttgaacagtccattcaggaaccttcaaagccacaccccagggggctcccacctcgaaggcccggggaagcagtctagctcagccgtctaagtggaggtgactgatttattctgaccatcctgactcttcacgacactgctctcctccaaccatgcacggctttaattgtccatcaagcagggcagggaggaaccgtaaatctttcctcccgctgctccgagctgagcctgcttgacctgcaattgccagcccctcgcctgcgtgcagcctggagaagtccgctggctctgaaggtgaaggaggggagtgaggaaggggaacgcaggagaggcagaagggggtcaggaggggaacagagagagccaggcagcaggagaaagcaagcagccgacatggccatgctcccgctgctcccgccccggggcccctgcggaggaatgaatgcctcagcccgactgcagcctcgaggggccccggctggggcgtctacacacctcgcctcccaggctcctgctctcaagcagcgggaccctgataaagtgagccagaccctcagggagtcttggcattcccttgccaggctataaaacatcacagccccaaaaggagcccgctgcgggggatactgattctccatcccacattcacggtgtctgcaactggaccccagctaggggcacaggatcctctcttagggtgggtgtctctgtgagggcagggacaggccaggggccacatagccccagctgtggccgggagaacagagctggtccaggaggtttagccacaagctccaaagcacgcccccttcccctgcagcagacttaatattttctgtaattttagtatatattaatgcacttcaaagtggtgaacattatagttatgattattacctaaagacttcctttatagccctcattttccagtgctcattactttctgaaaaattatccttgggggctgaaattttcctagtctggtcttgtgagttttcttcttaggttttaagcaaaacatatccggaagggggagaaattacttctcccaaagtcagtctccttggtgacttctgccaaggaaagaaccccatgggaagggggcgggctgtgtctttagcatgtagatactgatactgttatcagtgatctggccttagttgtgcccgtctgttctggagagacggctctattttaaaagtccaagaggcggggaggtacccatgcgacactcatcttgcatgctgcagcctgggcaagtcaggaaagtgaatgctggttatggcaatgctgccgacgcacacacacaagcagacgtattttccaacacaaagtgcagatctgcagaaagtctcctgtctgtggcctggggatgccgatagagttaaaagcatgcagattctaggtgtatccttctcagctgtcctagatgagatctgccggtgagaaagaaaaatgtacccgctggaagacggcctttaatcatcctataaagttgtcccagacaacgtcacaaggctttaatggtaaggaaaagggtaacaggctcccccatcaaacacaggccatcgtccacctgctctccctcccgccctttggccatcagctgaaggttcccagctgtcaagatatcaaacagacttctggacgataaagctcgacacagcgttggctgtctgggagtgttgattataatgttacgccactgacaacagtaattctcaccttaaatttcttctcttttctgctaagattccaaaatacttgaataatgtacccttggatagcacccctgcgaggaacacaaccaaccactgtcggtcttctccccagcagctgggggcacgcagccaggatggccggtgaaccacacgccccgtcccaggtctataaggagcctgtggaagcaacccctcgggtctctagttccacttcacctgtccctgccatgaggcccccagctgtgcctaatggcatgacatcaatgatagtcaatactccagaaagaataaaagcacacactttgttttttttttctaatgggctttgcaaagctgtgcttcggtttttcatgggttgagaactgagatccaaaaacatatatccacacggaaggcaggggtgagctggaatccctcagcctgcgcggtaagcgatgtggcagcaaactataggctcagaggagcccgggaagggctgggggagggaggccatgatcctgcttcctttcctctccctcatgggaaatccaactggcatggtctggagcctcatctctgatgatccaatgccactccctttgcaaaagcaagaggacctgctgcagtgctcctctctccttgagctacccttttttttttttttttttttagggggagtcttgctctgttgcccagactggagtgcagcggtatgatcttggctcactgcgacctccacctcccaggttcaagtgattctcctgcctcagcctcctgagtagctgggattataggcgtgcaccatcatacccagcgaattttttgtacttttagtatagatggggtttcaccatgttgaccaggctggtgttgagctcctgacctcaggtgattccctgcctcggcctcccaaagtgctgggattacaggcgtgagacaccctgccctggcctccttgtggtactcttgacaccccgctggcagtggaggcatggggagagcacaccgggcccattgaggggacacagcacaggcaggagccctgttatcccctggatggcctgacccgggtaacaactgagtccacggccccacagacaggaccttacttctttctgcctggcttcggggtgttcctaaggacatgagctgctgggggctgctccagggagcccttccaggccacccaagggagtgagggtcccctcagaccccaacctctctatagagacatgctaagggttgtttccatccttacatctgcaagtttatcttttaaagcgagctctattaaagcagcctcataattatacccacagggaacagtttggaatccattccttaaccctgacccttccgaaccctagcaacatgctcgttcctctactaggtggatagccccagggaagggtcccactcaccacatcagcggctttacatagatcgcctgatccacgcagcagtccctgcttctcagcagggtaaactgaggttccagagcctgccctgggtggcaaggctgggaagggtgcacgccctccccagcggtatgctgcaggcaaccctgccaccatcagaggtcagctccggcctcaggctgtccctgcacagagcccgcccaccagccagcaggtgcaggccgaatccactcaccacacccacaggttgtgcggccggccctgatgggctttaagagctcatgaaaggtaactgacataccgccttgctcagaagtcacttccatttcaatgtgcatgtaactgtgtgtgcccacgggcaaagggtgattcttgtaagaatcagctgatgggagtggggagctgccaagatgtacaacctcagaacctcccatgaataaggaaactaactgagtgaagactcagccacacctccagggtgaagggcaggtgtcaacaccaagtcattaggctttgcagagcccatcaggagcctgtgcatggacccagtttaaagcatattctgggtttcctttttttgctcggatctcaaggtgacgggtaatgtcgggacataccggtgtgtgcggctctcccaggtgatacattaaaaagtcatcctcacacctcgctgctgaaaacaaaaagctacaaagcccttcttgccattgctttttaaaaagtggggtgggctggggtggggtggggaagaagaggtcaccagcaggtgcttgattccaaggtgcccagaagctcttaggaacagaccctggagcttcagccagcccccagccctcaaaagttccagaaaaataggagttgtttttgatgtaatccaggagagaaacctctaatttgcattaagagtttggagctatgaaagtttagtgagaaatgatttctaaaggtaccagggtgtttgtacttgctttaaatctttctccaaattgtggaccttcctaatacaaggaaaccctatgtcctttggctccaaaagaggttcccatttttccatcaaaaatctcattgctgaggatagcctgctcctccatgttctcatgaccgttgcctaaaagcaaacgatccggagacatgagcctggcccaggaatcggcatttgcttggtgtccaaggatgtgaactgcaggatgagagcaagggcaggagaagcacctggactccagggacaccattcctgccatcttcatccctgggtctcacctggtgtcatagacaaggagacgtggatgagaaggactgcagtccatggtgttcgggctgctcaagggcagaactctgaatgcgcccttggtttgcgtggcacactgcctccactactgtattggtggccctgcagaagagaatctgatctggaggtccgggttacctttgtttgtttgttttgatggagggagaattttggagcaagacaagatgccttggcacacaggattctccgctctggcacaaaagatacatgttatgatctcaactgggcccccaaacaaggacttgaaactgttcaggggctggctggtggcagctttctatgctcaggcagtttccttgcctgcaaatgggattattttctaaaagggctaaaatagacatacccggccaccttcctcgccagctggcttccactcacagcccagcgttcaaggcagggtgggctcacctccccaaatatggagcagccagccaagcagagacctgcgcatacagagctgatgaccagcggtgggtccagtagggagacggccaggtacagagcggttgctccgcctaggcctctgttcttctggagtcttgggagaaagctctcagcacagccgctaaccaaagcaataagcaagtaaattcctgctaaaaatacatatattcttcctctttcttttttctgctgggaatatgttctgagcacaaataattaaaccttaaaagaaaacttgcagtagcaagtgcttggctcttggtcctaagaggaaaccacggaggctgaggacccccaactcaagttgacgccagcaagttacaacccacctctcaggtggaacccacgagccctggccccaacctacacggaaggagtggagacggatccaagggaagactgattttcacttctaaaaagcttccccaagccgcagctttctctacccacaaggggaacactccccacagaggagagcaccccatcccttgttcttctgccccctatcccctgactgcagagccttcgataccacagtcttgtcaatgtttcgagtgcagtgagttggcaggggcagcagcagtgagaagggagaggaggggcaaggagaccacctcaagctgctggtctgtctagagaccaggaagaaaccagaaggacgcctgggcctgaccagaacagtcaaggcccccacgtgtcttacaggtaagggccaggatcagaggcctgatgacaccaagctccctgcacccaagaggtggcctttgctttgggagaaaacatacttgtccacttagcacttgtaatttctataggagtcctatcacacagtggagcacatccctaggcccctaaattaaagatggtggatggtcctttcccaggccaagagggggactcccgtggtacccgggcaagacgcatccagaatgactccttccacctagaccctggccacacttttcaaaatgcaactgatagactgagctcgccccgagctacaaataaactaacagactttatactctttattattccagcctccctctaaggcgtgttttggtgtcagtctatgtgttggagaaactgtgatagcaaactaatttactaagtgcattgcacttaaaaatgtctattttatacaccaaatcagtctgtgtcacgtggtatttcttgaagggaggtgactcgtctgtctgtgggtccccaacccagaacaggccccgccgggtatgcacagcatatgtatgtgtgcaatgctccttgcatgcccgccatgcaactgttaaccaagagccgtcctcaaccctcacaggtcacacaaggaggcaatcacacactaagcatccgcgccactcagaaagcacaggaggaaaaaagagttggggagaggaagagatagacggacagggagacagggagatagacccaggacgttatagaggacagggatggctcagggagcaaccttcttcagagaggcagcagaaagtaagatgttgaggctgcctgaatgtttcatgagcctgtgaaaataccgcgctgctttatgaaagagcgtggagagatgctgcagcttatcaaagggtggaggtacaaacgggatgtgtttataaagccggtgccttgtgccaggagcaggggcctgtggcaggcagggatttagggaatggtaggttccctaccaaccaacaaacgggtctctgttgaagggggagaaagtttcaagatggcttcttccccttcacttgtttaaaaataaaaaattcctcaccaaatgtcagctgcgtgtcaggttccatttgtctttataacagagtatcaagcaggagcgtggaaataaataaacacagggagacaaccgaccaaaacttgcaggctctgggctgggctgggctagaggagggaagccccaccctgcaagggctgaaaaataatattgcagtttcgcgttcagcactgtggctctggcccactgacatgttttcctctctttactgccccccaccccctaccaccaccactctggcgcttctgggagggataggagcgtgacttatgcattccttccttccgaattgcacaggcatcatgggtcagaacaccatctgcgtatatgggggagggggcagataaaccaagcagggcccctgccctcagcagcaaggcacctccaactgccacacatcggtatgaaggcgccttaggccagggctgaatgtggctgggagagaggtgtcaaagaaggctgcaggggagaggcaacagggctgaaccagccagggaagatggcattttctctggccactacagtgtctagttcatccctagacaccaaagagcccgataatctctccatttcaccgatgcgccatcagccacgctccaagttgagtaagtgacaggcgcaggacagaaggcccactctggaatggtacccaggaggcctccttgctgtaattacctcttcgcaggccctgggcttttctggctcttgaatgagcctcgggagccctccccatgtcctcagcagcctgagggcggccgcccgcagcgcctccagcggccctgggaccgtgtcagaggagggagggcgaggagggcaggctgtggaggccccggccctgtccttggtgctggcgcccgctgagtgcctgctgagccactcagaggcaggggccgcccatgccgccaccttccctcgacatccgcctctggtccctgcggaagggcagtgaatactcccagccccgctgtggctcccaaccgaggtcactgggtgcggagcatttgccgcaaaggcccatccgagtaaggggcggagcctagggacttccctggactcctggctcctcctggcacccagaggcgacccgaggtccccggggtgggcacgggtctctctaggccccaggcccctgaggaaggtggatcaaagcaatcacccaggttcccttttttctttggggggaggagggtggatagctgctagaaatggacaactcaccccagaaaaccccggccgtgcaagcgcaaacagcccagcaccagtggcaacccctgccgcacgcacgcagccacctcgccaggcccaggctgtctcggcttgggtgcgtcccttcaaccgtgcttcttgctccttaaccccttcagtggtccccacgtcacccgctctgtctccctcctggggacagccttgccctcccagaagctgtcagccaggaaatgaagggttaagcgttgcttccaggagtgtgcggtgagcggtgagcgaggcgcccacgcaggaaggcctccagtcctgggggaggggcgggggggccagcctcggtcctcggccaaagggagctcctcgcccgcaggaggcggagaaggaaggcgcgccgggatggttctaagaaggctcccctcctccgcccccgccatgccgcccccacgcccccaccccgccggcgctcagtgacctggggcgcccctgcaagaggcccatacccggctttcatcaggcagcgccttctcgacaacttttctccctctctcccctcacaatttttgctcacctggagggtcggtttttaattagtgtaatatccccgtgaacaacgcagcctaattaagacatccgtcccgaatccgcgatgcacacttaatgagcaggttctgccgcaatgtttatactttttttttccattatgttttgcagaccagtaaaaccgaagccggcttccggctgaaagacctcattacgggcgaccccactccattagcctcctacctgctccacgctaagtgcccggggcgcccgggtgcatgcccaaggcgtccccgagtccaacctgcgtttggagcaggaaattagcaacctgcgcgcccgagaagcgacttcaccaccagctggggcaggaagggggacttaaacccagggatggatcccttgggtctctgtccttagcctccaccgtggggtgtctcgcgcgtcgggactagcggctccgcgggactcctttttaaaagtgatcattaaataaatcaggtacctcgccaaagctggaacggaaaggggagggggaggcagctctgttgtccaggagtttctccccacctcgctgggcccccgcccccaccagtggactccgggaacatcccacccccaccctacgtgataccagggatcccagggccgcttggggacccgacaggttcccaatgcccctccacgcggggcgccgcgtctcggtccccgcaccgacactgcagggctgcgcgccaggggaggctccgcgtcccggggagggaggctgcgacccccagcaccaaaatgaccactggcctcgcgccaccccgagacgccacagaagaccaccttcccgagcgtgcgagcccaacacgccccgggcgagccccaccaccgcccggggccaccagggcagaaagtttgggccaggggcgtgcccggctttcccagcccggccgcgctgctcgaggccctgggggtggccgaggcttcagagaggcagcctctgctcccgttccagccttcctatcgtgcttggggactcggcccggagcgcccccagcccgccccctgtagggccctgcgcgccgctcgcccctcgctgctcggcccccgcgcacaccgcggtgctgcgggccccgctcctatttggggagctgtggcagccccttcctccccacaactcctttgggtcatcaacctctcagcgaccctcctttcagaggaccccggcagggctctctccgggcctgggtgccgcgacagacgcacgttgcaccaccgccgggtcgccagcctctctcccacccgcgcgggctccggctgcctgctcggacgcgccccgcggggccgggatctccgcgcgcctctgcctccccccgccggggagttccccgcgccgggcattgtgccgccgccgccgccgccacagccaccaccaccgccaccgccaccgccactgccaccgccacgcagcgcgcgggactctctggcgtctccatggagcccgacccccgggccttcccattcacaaaatcgcccctctggcccacggccggacagagcgtccagaccccagccccggagggacccagggaccccgaccccgcgcagggacccctgaccccgagggcgccaccccaccccacgcgccctcgggtcagccccggccgcgctcagcagcccgcctcccactgcggggtcccatgcgcccctccgcggccatgtccccctcccccagctcagcccgatgggaatgaccgccgcagagcgaggcgggcgacgaggccaggctactcacgggctcagcgctccccgcggcaggtgactgggggccggcggccatgccccggctgcatcccggccgccgagcgggcagcggcgtcctggggccgcacaggcaccggcgagccggcggcaaggggcgcgcgaggccgggctcgggcggcagctgtggcagctgcttctcctccgaccacgcgagctgctggggcccggctggggccgctgtccgaggaggttctgctggcttcggagcagccccgcgctcgctcttccctcgcctcctctctctctctctctcctccctcctctctccgccctcctctctctctctctctctctctctctctctctctctctctctctctctctctctctctctctctctcgctctccgccctccttctctctctctctctctctctctctctcgttcctctggctcgttcggctggagcgaggcggcagcaggagcacgcggcggcggcgcgggcggcggtggcagctcgagcggagcgcgcagcgcgcggcatgggagggggctctggctgtcgcgcggccggggagggcggcggagcggggagagccatgaccgggtgggcttcggcggtcagcaccctgcagccttcagcgccaactcctcggggcaggggcacagaagaggtggggtacacacggaagatcccagaacccagtgctgccctggtcccttcaagggcagccccaagcccgctgcccctccccacctccaagctatcttgggggcggatcaacccaggtgacccttaacaggacccctgcccttgtgcctcgctgtccctgggggccatttttctttgccaggcccagggatccccagcaatgggacgtggtcaccaagcatcagggacgaatgccaccccaccccgcatgccatgccatgcctttgagttgcccacataccccaaaccccctcactaggcccaggtgccctgacttcctggaggaccactggaaaggaagggatcgggcccactccgtgctgttagtccagattggccaacccaacccatttaaacatttccacctgtgcctggctggagaggaaggactgtgggaggtcagcttaggatttccctaaaatcaaaagatcaggtagctcctgtccccagtcccagcctcccccagcatctagagtaaggggcctggtgtgagttctgggagggtctctatccttggtgcagagggagcaggagagcagaggctgaggacacagtggagtggggaccctctggaaaggcaggagagatctattgctggggtcagcccaccactggcacacaacaccagaagtgggcaagaaggtctggacggtcccaaacaggtttaggcaggaggctgagtaatcatttccaaaacaaaagacattctggtgcagcaaccaggctggagaaacgagcctgcaccatcgaaggacatttccaaattacacacaaacagatccaaacccgtccccatgtcacttttgctcctgaaggctgctcctggaacaattagcctcctcctcgcacctgactgtcctgcttttctgtgtgaggtgaaaagcacatcatggaatctggggtttggtaggggcctggaagacccagaggccaggaagaggggagtatggatttggagcttctcggtagtaggggctctgggctgctggctgccccccctgcagggcagcagagacggtggccaagacagtggccgctgcccacttatgagcgtcatgcttttaatttctggccctccagcccgtctgggtcattgatctgtcttggccggtgggaatcgtgttatacaattccaagcatacagctaaacagccccacagctaaccaccagataaatgccgtgtctacgagcaaggcagccgcctggttgactgaactttcccctgccaccggatttgaaatggcgcattccagctctaaagccctaattgggcctcttggttctctgctgtcagatggtccaggctttcgtggcctccaactcccggctgggcccagccactgcctggcaggcacctgtctccctgcaggcagggctcttgcctcgctgtgccggcagcgccccctgtcggtcccgcttgtcccttgcccacatttcttctccctggggagccttttcctctctggtccagaccctactgccctttggagcctcctcgcagaaacctctcgaagagtgggattcgagcccatctccgtctcccttcagctccccatgcgagttctgcatgtgcctgtgaagtggggacacattgacctggcagagctgtgtgcccgagtggaagaggggtccctgcaaagcatagggcccggtaaatcattccttggggacgttctggaagagctctctgaagacagcaccaaatcttgttccaagttccaccagtcccagcccaggactcaggacacggtgggcctgctcagacgcccgggtggtaaactgaaattggcctctgtggttgggactggccacagggcctgcgcgtgaggacaccccttgggaacaggccccagccaggccggcctcattaccagccccagagagtttgcccttcgtgctcagctgtcgtagacagggatctggccggaagagagtaagtgtcagggccagcaggacataccagcactaaccgggagattttccatttggggacgtcatctaagagaatttttaaaacctctgatttggaaactttaatttttaaaaagtgagcacatggggaggactggggagtccttggtaataatcattaggagagaaacacagggagactgggcttggggccaacaggacgactgaaggcacagagctaatttcgtgccctctgaaaaatcccactaaaactacaaagagaaaattttaaaaaggggctgggcatggtggctcaagcctgtaatcccagcactttgggaggctgaggtgggtggatcacctgaggtcaggagttcgagaccagcctggccaacatggtgaaacgccgtctctactaaaaatagcaaaactagccaggtgtggttgtgggtgcctgtaatcccaattacttgggaggctgaggcaggagaatcacttgaatccgggaggtggaggttgcagagagccgagatcgcgccactgtactactccagcctggacaacaagagtgagacttccatctcaaataagaataactttaaaaaggcataaaccccaacgacctggagaataggagaaaagagaacagtagccggctgtgggcagcggggaggcacaggagaagtggcggcccgccctcacggagctgagtctcggcccagaggcagggaaggctgacaatggaatcccccgaaggctcagaaggcgtggggcccaagacccggggaagcctggagatcctcggatagcccctctggaggtttattccctgaggacactgaagcagcctctgtggcctgggggccgccagacactgcggacagaggggcgtcctgcacggagagccccccttttccctcacggcacctgtcagcatcctgacctccaccctcctggcaggaggccggaagaatctcctctggggaatctcaccagcacccagaggggaaacctgaagatagagctttgctgcttccaagcacaggccccactccctgctcggagctgccaaccagctttgcagccccccctaaggtgagtaaaaagccaaggatgaccagacacctgcggaaagccttcatgagaaggagccgccaaaacacgcaacagagcggggccgacttcgaggaaacagatattaggcagggaggagaaaacatcagaaatagcagtatttaatatcctcccagagatcagaggagataccgcatccatgaaccaagagcagggtgctattttaaggagaacatttagagaacaaaaaagctgggaagttaaaagcatgagagcagaaacaaaacatctcaacagacaggctggaagagaaaagtaagggaatgccccagaaggcaaagcaaaaaggcaaagaggagaaaaagaagaaagaggggatgaaaaaaaactagatgatcaattcacgaggctcaacacaaaaggaattctaaccccgacccccatagggcccccagagagaaggaggaggaggagaagaaaggaaatcatcaattacttaagaatttttttccagaaataagtttccaaattgtccacaaaatcgatggaaatgattcatatcaaggcacattatcttgaaaagtaaatcactgaagaaaaaaaaaaaatgtttccccaagtttccaggtgccataaaaaagagcaggaacgagaatagctccagaattctcaacacaaagagggcagctaaccaatcacaaagcgtgccttcaaaagctgatggcaagtgatttctggcctggaatcccttacttcacaaaattaacaatcaaacgtgagattaaaacaaagacatttgcacatgcgagatctcgacaaaattatttcccacacaccatctctcagctaccagaggacgtgctctaacaaaacaagggtgtaaagcatgaaagagggcaatgagggatggaagaaacagaggatctagtaagcgggcagggatccacatagtgggagaggagggagggcaggagggcagctgtgtaccgggcaagaggttgccagtccagatgagagcagggtggtggcatgtccagctgcctagggctcagacatgtagagggctgtcactaccaagatgcctcctgccattgtaccaccctttcagtgccaggtgagcctggcccctgctcccctctgtgcccggccggctcgggccatgttgcagtggagtgcctgttttcctttccacgcactgccacctgtgtaagctgaagaccctcatttcgccccatggaagcatttactttgatccactcttagcatcaggaggtggccacagggaacaaagaaacagaaaacacacatcagcccaccaacctgcaagaagccccagccaaggaggcccttggttccccaggacccctcatgccttgcccaagaactccctaaaagaggctcttgtaaagcgtggggcagctgcggttccagagtttcacattctcttctcccaggctcctccgtctaagggtagcagacccaaatcatcacagacagaaaggacatcatggccccactttcatattcagcactggacacatccacagatagaaaggaggtgaagatgcaactgtagaaggatcgaggaaagcaagagatcaggggcctgctttttccttgctggtctttgacgttcttgtgaggtccacagatggccagcaccgacggcccgttggagagctgatgtcaccgccattggctgccttgcttgctctctcagtccaacagagtaaattataaggttactctatgtagtcgtaacctccttgttaagaatggatctctcggccgggcacggtggctcacacctgtattcctagcactttgggaggccgaggcaggtggaccacctgaggtcaggagctcaagaccagcctggccaacatggcgaaaccccctctctactaaaaatacaaaaattagccgggcgaagtggagggcacctataatcccagctactcaggaggctgaggcaggagagtcacttgaacccgggaggtggagattgcagtgagccaagatcacaccactgcactccggcttgggcgacagagcaagactccatctcaagaaaaaaaaaaaaaagaatggatctctctgtctctctctatacaaacacacacacacacacacacacacacacacacgtgttactacttccccactactgccaggcctgctaccgctgttgtatgtgtcggatctccccttcaggccaccatccaagcacgctgtgggaccctgtgcagtcctgcatcaataaataccacttagggagagccccacacgacctgagggaatgtatgatcaaaacgccccactactgtttcacgaaacacgcggggcagatgtgcaaacatttatactgtgtgggctctcaggggttgtgcacctgtccgggctccatggaatgtaggtcacaaggagaccttggaggtcagagacgccaaccagctaacttaaatgaagacgtcacagggccgggctgtgctctgtcccatagctggaagagaggtgttcggccctcacacacccagcctcagcctcagctgtgtccgccggctggctctccgctcttcacttcagtcccaaggtttatcatccctctttctcctgacccttttttcctggcagatggtggcacagtttcaccttgaagctagagccttcagtgggagcagctttctccctgcacgcctccttctagtttcatcttgtcttcctgctccctttcaaattcttcttccgttttctccctccatccagccctctcttgctctatcctcttctgtctttcctgctctggggatgggggggtcttagcctaccagcctaaaaaccttatctggtcttccccatccttccagaagcacccctagatgctcttctctcccctcgttccccttccatcctcgccttccctcgatcacaagcatccctacctccacgtccacacccacggacaccccagggaaatggctctctcgggtcaccagggaaggctgaatcacaaacagccaggcctgcactccctccttggtttacttgatcctttactgcaggtggccccgtggccaagtccctttctagaaacctcgacttcatcctccaccacagcaccgtctcccactcttctctcccgaggttgcacgtcagcatctccacctgtctttctctgcttctccctaaacaccagcgtcccattttcccaggtgatcctatttttctccccaatgagctcatccctccagtggtctcactgtcgtggaagtcatccccgcattttgagctgaaagcaacttcagaggtcatgttgcacagtccgcccatatcacagatgagaacactgaggcccagaatgtcccgtggctcgccagcagctctgggtcctggcctgggatgctgcctactgcgccagccccactgccccgccgcctcttgtgtcacatgcagggagcagcaagcgcatctgcgatgtcacatgtgcacctccaggcttgatattttatttaagagtgtgcgactccatatcagtgcccagtggctttcagttctgacatttatcttctccagaggaggatgaaccacttgcacgccgtccgtctctcctcccacgtggatgggaaatgtcagagggaagtccaggtagttcagggtcccacgtccacaccacaaggatttactgtttttgtgctgcttgatgacacagctgtgtttggggagcggcgatagcctaaaaaacacacaagtggaaatagcaaaggttttctgaggcaccgtcaatttctgcagccggggcagtggccagtgtctccgggaacaggcgccgcagtccactcaggggcccacaggttcttccccgtcttccatctccttgtcttgagtgggacgtgagccgtatctctgagctcagcctgtgattgcacaataataccacccagaaaacaaattaaaaataggaaaaatccatccaagccgtgtgtctgctcaggcagaatagtgtcagattgctaggcaactccaggcagtcctgggggaaggagggccgtgctcagcttgttctgcagaagtagagtccttgtcccttttgtgtggatgtgctcagccgaatctcagcaaaagtcatgaacagaaaggagaggcgggctgcataagccggcggagtgcacatccgtctggacaaatggattttccggaggatggagaagagacgggggtgtccacgtgatgagaaacatctggatacgcgctggaaaaatcaatctgatttctctgtgcttcccaagatccaggtgtttacaattgtgtaggcaaagcgtctgaatgttaatgaagtctttcctctcaatatcctgcatctccctcagcaagaggcaaatgaaaactaggctcagcaggcctgggagagacggggagcaggaggaggaactagagagacccaggcagaggaagccgggaaatggaactgggagatcacactcgcccagtcggggtttctgctcccaggaaggagatggaggcaacagggcaagaaagacacgtgcatttttcacagttcagtcgaaaccataatcatattaatatgtttgtggatgctaagacgttggctataagcatcaaatacttttcaaaggaagaggcaggggacgtggcatcgtgaaaaatagcaccaattttccatttgattgtaagctctttagcactccaggagggtagaacctcgacagcgtcttctcttttaggaggtgcagagactgcccagggccagcacaaaagcatggattcaggtcctggggctgccacaacaaagtcccacaaaaccagaggctgaaaacacagaaacttattctctcacagttctggaggccaggtgtttgaaatcaaggtgtcagtggggccaggctctctcaaaaggctccagggggactccctcccgtgcttccctcctcgctcctgggggccaggggcaatcccaggtactccggggcttgtggctgcgtctctctgacctccgcctctgtcttcatgcagccttctcctctgcccttctttgtacaagggcagcagtcgttggacttagggccaccctgatcctgtatgacttcatcttatctaactatacctgcaaaggtactgtgtccaaataaggcaggctctgaagttctaggtggacatgaacaggggatggggggcagctcaacccactacaaagggcttgtgaagggactcaggcaggctccggggcaggtggactccagcaatcctctgatctcctccacgtccccgacggacagggtgtcacccaggaagcactccagggacaagccattcaccatctcccctcctccagccctgggggagcctcctctactggaaaacatccttttcaacagcaaccaaattctcctctggccgtcgtccaggttggagttcagacctaccttctggagtaacgaaaaataacaaaaacagcaatcgtggctgcttcccgcaccctggagcccaagccaaccacacgcgcacacacgcacatgcacacacatgcacatgcacacacacacgtgcacacatgcatatgcacacacgcacatgcacacatatgtacatgcacacatgcacacaagcacatgcacacatgtgtgcatgcacgcatatgcacacatacacacatgcacacgcgcacacacatgcacgcgcggacatgcacacacacatgcacacacatgtgcacatgcacacacgtgcacatgcacacacagggacatgcacacacgcacatgcacacatacgcacatgcacacacacgtgcacacatacgcatatgcgcacacacgcacacacgcacatgcacaaatatgtacatacacgcacgcacacagacatgcacacacacggacatggacacacacggacatacacacacatgcacacatgcccacatgcacacacacggacatgcacacacgcacgtgcacacatgcacatgcacacatgcgcacacacatgcacacgtgcacacacgcacgtgcacacacgcgcacacacatgcgcatacgtgcacatgcatacgcgcacatgcacacacgcatgcacacatgtgcacacccgcgcgtgcacacacgcacgcacgcacgcacacatgcacacacgcacatgcacacacgcacatgcacacacacgcacacacacggacatgcacacacgcacatgcacacatgtgcccatgccgtcctgtaggtatttctcaggcgaccccctccacaccctgatgccctcctggaaccccacatgattctctgggggttcctcaatggtcccagaacctggctccaccctccacagcagggcaaacggcagagaagggttatcattcctgcccttgggacccaggctgtccactgtgacgtccttagctgccacatcacacccgatctcatttcaggctggtttcttctacgccgttcctggggacatccagacatcagtggggtacttctcttactcctgttaaagttaatccaacttcttttttttttttttgagatggagtctcattctgttgcccaggtgggagtgcagtggcacaatctcagctcactgcaagctccacctcccaggttcaagtgactctcctgcctcagcctcccaagtagctgggactacaggcacgtgccaccacgcccggcttatttttctatttttagtagagatgtggtttcaccatgctggccaggcgggtctcgaactcctgacctcaggtgatccgcccgcctcggcctcccaaagtgctggaattacaggtgtgagccaccacgcccagcctgtccttcactttgtattatcccaaagttgaaacccagcaccgaagggcttgatccaagctgggggaaaccgttgagcaggaatggagccctgagcaaccctgcaaagccaacgatacccagcgagggggccatcctgaatctacacattttcaaggtgcagatattaaataaccatagtaaaagcacgtctctaccaacaggcagaagtgagacttcactgaatcatgttggtcgttagagtttgcaatacactgagtgcctgggtggcaaattctgacctgtacaagtgtccatgaacttctcagtgatgactgtcgggtcaatgtcagtttcatcggggcataacccagtgtccttcagaaaccaagtgcgggagtcgtgcatgtcactaaatgttcatgcgtgcctgcaggactcaggggcacgtggctgtgtgggatgcagcctctatgggaagcttgctgctagcactgctagcacgtgttactaggtgtacacaggctaacccagtcaccacccacaaaggcagcagctgctggtggctgctctcacccgtgtgaagacacacacatcatacaagatcgagcgtgtgttcatgacaccgcttaagagacacccgaatccggggagaaggataagggacaggctgcagagaagaccgcaagctaatctcagacctctcagaccctgaactgtgcgtgtctttgaattcacccttaatgtaaatttcattctccttagttcaagatctttcaaaagtagggcttttctaaggtgtcctttcattctcattctcctcctggagactctctgtgggtttctcttcagccatgcacatgttactaggtatacacaggctaacccagtcaccacccacaaaggcagcagctgctggccaccaccgccagccagactcacatcttggcacaccttcagaccgcctgcccgtggagcctgatggggtggggggtggcaggaccgagccccctccttccagttccaacctgctcttggagaagcatctgtcacggggagtggcagccccgtaccctgcaccctccccgggctctccctgcctccccgagactcagccagaggaggtggggctgggaggtggcctctccctctcacagggccagaccaccactgctctccctcccccaggtctgagttggctcaggccaccgtctcagaggaccgcagactgtggatgtaaacattcattctcccgcagatcttgaggccagacgtccaagatggagatgtcagcaggacggcttccttcggaggcctctctccttgctctcagctggccgtcccctccctgtgtcctccacagccgtccccatgtggcctgcattctacattccctcttccactgaggacaccagtcaggttggattggggcccatcccaccacctcatttcacctgaatcacctcttcaaagatcctctctccaaacacggtcacacgcagaggtcctgggagttaggacggcaccatatagattttgaggggcccatgatatacctgtttcttctactaatgtctttattccaacacagccacagtggttcctgttctgcaaacgtggcagagcctccgctcctccccttccccagctgccactccccatcagccacaggccccatctctaccacgccctgtcctcagtgccctcctggcctccccactgccctgcctcagcccagaccctcagctccctcccctacactcatgtacacctgaccggggagccagaaacgtgccccagccctgttactgccccagcagaatccttcccagctgaagaagagactgcctccactcaggatccttccctgacctctgcaggtgtgctcatccccatctacagatgaagaaactgaggacttgatagacgcagagcaaggtatggggtcaaggctgaacttctagaagcaaccaaaactaccaaaaaactggttcaagaacaccaccatgcccactgctgcccacagcctgggcgctgagtttgagataccccacaggagggaggtagaatactggccccaaaatgtccacgtcctaacccctggaacctgtgactatcttaggttacacagcaaggaggaaggaaggttccagatgggattggggttgctcactggtgaccttgagatgggaggtgatcctggatgatccaggtggcccaacgtaaccacagggtccttaaaagtggaagaggagactgggcgcagtggctcagacctgtaatcccagcactttgggaggccaaggcggggtggattgcttgaggtcaggagtttgagaccagcctggccaacatggtgaaacgctgtctctactaaaaaataaataaataaaaaattagccaggcatggtggcccacacctgcaatcccagctacttaggaggctgaggcaggagaatcgcttgaacccaggagatggggattgcagtcagccaagactgcaccactgcactccagcctgagcaacaagagctaaactctgtctctaaaaaaaaaaaaaaaaaaagtggaggaggcaagagagtcggtgtcagagacaatgtgatgatggaggtgggtcggagagagctgtgctgctggctccgcagggtgagggcttccatcttgaagaaggaagagggagctgggagccaaggagcgcaagcagcctccagagactagaagaggcccggaaacagaccgcacctttgacactccagaagggaatgcagcctttctgcattttagcccagagaggccagtgtcggacttctgacctccagaacggcaagataatgaacttctgtgttttaagccactaggtttgttgcagtttgttacggtagtcctagaaaacttaatctaccacttctacaccaagaagggtgacgcttcaaccaccccagtacagcttcctagagaggggaggcctcatctccttccccgagacccgtcagctcccggatcagggtctgccatggacacacctgcctggccaagtccgggccacatggctggccttagctgcaggggaggctggggaagggagggaggctggggaagggagggaggcagccctcaccctactaagttccatcattccagaaagtcctccatcacagagaggcctccagttgccaggcagccagaaagacagggaggagctccagggcagggggtttggtggaatctggagactcaagtccaacagcgaccacagagccctctcagagaccagcaagtccgaactaaatccagagccgagcgaagggagcagctcaccctggtgcctagcaccacctcagtcctctgtctctgttgaggattttctcgggacctgcttctcttgtgtccaggatggccaaggtgcttcggcacttctggaagtaagggccctgccgaccctccactcacaggcagcccttggagcctgcagacgcctctcccatgtcactgaggttctcccacctctgaactcacccttagaaggcacccccgccccccgccccccgccccatccctcaaggagaaccatccggagctcccactttgggcacactcactgccagccaagctcaaggaaggggtccccaccacgaagcgccccaagggcaggactcctgccctgtgtactcagagactggggaaggcagcatgtgtgtgtgtttaaagggcgtgattgaggtgtgactggcatatggcacacctcccatggttaaagggtacagtttatgcgctatgacatgcagatatgcccgtgaaaccatcaccaccatcaggatagggaacatatccgtcacccccaaggtttcctcctgccctgatgtgccctcctcctcctcctccctctccctgtattccccacccccgggcaaccactgccttgctgtctgtccctgtacatgagtttgccttttctggagtttatataagtgaaatgacacagtacatacttctttgttgcctggctgccttccctcagcaccgttccccagagatgcggccatgcccttgcctgcaccaaaggttcactccttttcattgctgagtagtattccatcgcatggatgtgctacaatttgcttagctgctgttggtgtacatttatctccaggttaggggtatcgtaaatcaaggcactatcaacatttggatggacatgtgcttttatttttaaaaataagtgagtttggggccaggcgtggtggctcacacctgtaatcccagcattttgggaggctgagtgggggcggatcacctgaggtcaggaattcgagaccagcctggccaacatggtgaaatcccatctctactaaaaatacaaaaatcacctgggcatggcactaggtgcccataatcccagctactcaggaggctgaggcaggagaattgcttgaacccgggaggtggaagttgcagtgagccgaaatcgagccattgcactccagcctgagcaacaagagcaaaactccgtctcaaaaataaataaataaatgagttgggtaaaggtgggcatgtggcccactctcacccgcccacacacgtgcgcagacgggggtggctgcggccgctagggcatgggaggcagcaccccttaccaccagcggaagccccaactttgagagcgagggggtttggggggacgaggtgctgtttatggttttgcagttgctccaggggaaaggcgggctaatgaacagttagtgggaaatagtttattgaagtgaacagaacaagaatacattaaaattattaagactgtggcctggggcagtaagcggcatcctgttttctcatagtttacatgacagtgggagaacacaggaagtggggggaggatgctgggggcaaggagatgcagggaggcctctgccaagggtcaggtggaccagaaacttccctggactcatcctccaaaagttagcatcttctagcagaccctccaacctttgcacctcccaccccatcccattccgtccacagcagtgcctcctagccacttctctttgcttactaacaaaagaaaagggggaaagccttccttcccagctagggcaggatgctgtctcatcacctgtctcagcgggccacgccagtaagcaggaagcggccactgtcgcttctgcagggaaggaatgggcttcccggtgtctccggggcttaatactaaaatcatcatcccccgtctggaaccaggattctcacggccccatctgcattctccttttttgtgccaatagcaggattctcgatattcagctgggcacctcatcgtccaggataaagaccacgcctcccgggctgggtgtgagtctgtgactactctcccaccgatgggatatacacagaagtgacagctccagctcccgggtcacacactgaagggggcatccccccatctctaccgcatgtttgcaatgcggtgaattgtgagccttcttgggccaagcatgtgggccgacacccttaggatggggagtcccgagagagaaggtgctcgagcctccggtgacctcccggggctcagccacctgcctccagatggtcacttctgagaaaattaacttctgatctgtggaagacccatggaagcctggagcctcggtcatgctcagcctcatgtatgtcttaacggaaacaccatttctatctcaattcagcctcgagcctcagaatgaaacaggaagatgcacccagcaaataatacttttggcatgttactaataaaataaggaaaggaaaaacctggggctcagacggtcatctgatttgccaacagccacacacggaggtgtgaccaggctggggactgcaggagccctggcccttccctgtccagggaatgtgccctctgaggagcctggtctgttattctgtttccagcagtagtaatcaaggaccctgggctcccaggtgactttgaccagtgcctccacctgatgccaccttccccccaggtgcatcttcaacatagcttcccccaccctctggagtgtccagctgggcacaaccaggccccatggcacctgagaaataggaacacagcctccccggtgaagtagaggagagtttaagccaggactttgcctgtgccgagggcctgggagccgggctcagctctgcctgcctgccagggatgggaccagggctcggctttctcctctgctaacaggaaagaccccataagccctcaggcctgactccaggagtgagacctgtgattctatgtgaaacagccccaggctgcccacagcaagccaaagaataagagcccgcgcctctccaaggatccgagacccaagcagcctggtgccttctgcaaaacctcttcctgcttctcttctgcagggagcagcggcgtaggtggctggggtggtagggaggagaggtgagctgcttattgctggagatgactttcctctctcctcctccttctctgggcagctcgttttttccaaaataactcttcttcctccctccccaggttgctagtttctgtctctcctccaggcttccaagtgccccctgcaagggcagccggcggagggagcaggggagggcttacgttctcaagatgcagaagtacaagcgtagacaaaagagacccccacggtccccgtcaaccccctcacctctgtttgagcccccatcactcccctgggctgcctctctctgctggcggcagaacaactgcacagaggctctgctcaggcctgctccccgcccaagggtcctcacagcatcccaggcctcagagaaagcggctgctttaagcatttaaaagctcctacaggctcaactccccctcctctgttccaggacccccaactccaaacaaacaggtgtgctgatctatgcttgaccaggccggagccctggtccccagctgcccttggctcaagtcaccctcccagcctagcacatccttctgttccccaccccaaacaaggacagacctagggatgaccaaccccggcctggccccaatgcgcctcctgctcagacctctgcaaacctgatcgtttccccctcgaagactcccctggattgtgggacaccagttctgatctgagatcttagggctaacacaggaaattaggggatgggtgcatagatgcaatccctgcttcatcacaaggccgcagagtccttgtctgccatgacgtgcccgggtttagactgaagaggcaggagctggggccagcgaggggagccctgaactccattccttttaattgaggcgaaatttatataacataaaagtagccatttaaagtgtgcaattgaggggcactcggtgcattcacaatgttttgtagccagcacctctatcttgctgcaccttccatcatcccagaaggaaagaccttacccatgaggcagcaattccctgtctcccaccactggactttgtgttttcttggaaagcttttgatccgagtgccaatctgccctccagaaaggcagattgtctatttgatgataaatagacaaaaggcaactttctcctattattcttgcttcacagcaccggccctttggaataggagcatcacactgcccttgtcccctgggcttgaccactgccccaagcaacacgagggggcatgaagaccacagcagtgtcctgagctgccttcctgatcgactttgctatttgcccaaagaaaggagtagctcatgcagggcctttgttcattcattgattcaacaactattctttgccacctttgaagtgaccggctctggggcaggcagaggggcccacaggcacgagcaagatgcaatcctgcccccgtgccctgggtgtggagttggggagacaggtgggtgaacagccagataacaagtccacctggtaagtgctctgagaaaaacctgaagaaataatcaacctatagggtggctttgccatcttctccaaatattgtcctccaaatttcatgcagccatcttcacctcccaggccatctttaactaccaaagccagggccacacatgctgggtgacacctcagcatgcagggacttgaagaggccactcacaaaagaagactgagaaatgactccaaagcagggacagtgtcgaaccccaccagtcaccaaagcaaagcaaatcaaaacaaaagcccacttccattttttccacctgccagattttgaaaatgcccattgcacccagtgcttcagggggtgcggggaaatgacctctcattcgcttgctggtgggattcggagtcagtgtaatctttctggagggcagattggcactcggatcaaaagctttccaaatgtgtttaacctttaactcggcaattccacttataggaatttaccctaaggagaaactcaggaacaaacacaaagacttatctggaaagatttatgtactagaatatttgcaccattgctcataacatcaaaagattgaaaacaaactaaatgtccaactccagggtgcttggtaaataatttgtgcactcattaaaaatcctattgtagaagaatattgaatgccattgcaaagtgtttataaaccattaaatgaaaagatttataaaacagaatgtgcaaagcaatcccattatactccccaggcctccgaagcaggctggaaggacacactcctgggcctggcagcggtttcctctgtgtaagtggacgacgggctattttgtattttcttttttgaattttatgattatattctaaattttctacattggatctgaatcgtatttgtaattaagaaaactataaggaaaaattttttaacttggtaaggcatgtcatggatccagtttctcccccaaggtaccagctcacaggggaaggaagactaaaggactgctccctgatgaacgtggggatccgcctgtagggtttccacgatgctcgagaaccccgcagagtctcaggcctttgaccaagaagactccagagtgagcgccttagggaaacacggtcggccaagcatgcagcacctccgtgcccagactggatacggcactaatgatgcaaacaagtcatcgctcagtcagggagatgggtcattgttgctgttgtttttatttgttgttcagtggccagatgcaaacgtgttgcataagagccacccagaggcggcttgagctcttctcggaggaaatgtgggtactgtgttgcttgatcctgcctcttgacagtcctttccagattcaagtttaaatgggtttgccggtatcaggatgttaggggctctccaaatgccagtggagcaaatggcccattgcagacacatttccaaccctcatcaggggcttctcaggaaaaggcccagcccgtgttaattattatttgaacacaagttctggaagtttcatccttacaaaatatttttaacgctcgtggttcaggagaggaagggagagaagtgagtaacacttactgactccctactatgcactaggcacctaacgtgtattttctcgtttaaccctcaaaataatgcagcgggtctgcattattgaccccagtttacagttgtggaaactgagtctctgagagtctaagtgacccagacctgcaaggtttgctcagcacccagtagcaggcttcccccagagcaagcaacccggaaaagcacgacagcccccgccccacgaggtggaggccacagtctcttcagaacctcatggccagggacggccgtcagagccagagtccactcagacagcaaagcaagtcgtctctccactacctcacgccagtgcctcttgcatttggattaaccagggtgatttctaaatctggacgtccatcctgcagcccacacagggtgcagtcaaccctctggggtgggactcgcatcaggacgttgaaacctcccccggcggctccagtgtgagaaccactgcagatgtgggaaggaaccctccagccttcaaatcaccacatcatctgcctcggccatctcaagaaattcatcaggaagtgtgggtctaaacactctatagatgcccccagggtcaagaaggagacacgggcagtgagagtgattccaggaagaaagtcgttgactgcaattcacacggtgcacgggcctatttggaggcttagggaggacccagatgtgaatttacaagccagtgtcagacaccagcttgtacactcatctgcctttcagggactaggtcctcccagaccaggaagacatccaccttcagcgtccagactggggtccatgagggaccggccagggctgaccacacggggcctgggaggcaccaccttccccaccatttctcatggtattgacctttgattatgttctcaaggcaccgaggaagtgtcttctcaccgcagtgtctcaggaattccctgcaaccctccccagtggctcacctctcaggaggagctgcccacacttccctagagcgggggccagaagatggagaaatgatggagacccatcttcacgggcctagctccaggacacaggcagacccagccaccctcaggctgctccccctggaagaaggatgccagctctgtggggtccctggagtgtcgtttataattgcccttgcacagcaccctgacggagggtacccagcagatccctcaaggttctccctgcccccagagaatgaacagctcacggacagcagagctccgtgtcatccgcctcctgccagggcacaggggatcctggcagccgatgtgccgtggtgcctgcggcagggcaggctgcgcagggagacagcgagccctccgcgctgcaggaatgtgggcctccttccttgagaatgcaacatttcagcaaccaagagacaactctattgggagaacaagagctaattaaatttactgggatcactgaagatgaaattatttaatattctgaacagaatttaatatttgaaagcacgaacagccttggttcgttgtagacgggttttccatcacctgggtctgcattaggaggatccgtatacagatgaggggtggggccggggatgtgctgcttctggaaaccagaggagatgggagaggaactggaaatgggcaggaggacaaagtcctcttcaggatcctggatgattctgctccacgtttccagagggacccctgttggtgcctctaaagtgatggaaaatcacagttgtggtgccaggaccccatgtctggggtctctgaccactgcctgcctccgctccacctatctctaacccagggtcattgctggccaagtcacatggtgaagtcagaggatccggaagccagtgctcttccctggcatgcacgagtccccggccacacgctcctgtggcggagtacagtggctcacacctgtaatcccagcacttccggaggctgaggcaggcagatcctttgagcccaggagtctgagaccagcctgggcaacatagcaagaccacgtatctactaaaaaaaaaaaaaaaaaaaagttagcaaggcctgatggtgcacacctgtggttccagctacttaggaggctaagtaaggcaggaggatggcttgggcctggaggtcaaggctacagtgagctgtgatcacaacactgtactccagcctgggcaacagagcaagaccctgccttgaaaaatttcatttaaaacactcctgtattccacaggggacactgaaagagagatgggcacttttaccaagtccctgagatacccaagtttggacccagtcaggaatttctcagccatttttcctaaagtcactctgcagaccatccacgaagttcctcaaggagagtttctcctaaaggagctgtcggcccatgttggcaacgccccacagtgttcacggggccatgactcggcctccagagtccggggctcggtttccccagataccctggaaaaactgtgagtacagagcccaggagccacagctaagactcagccacctggggctcctgcatgggcaaagtggccgccagaagactccctggagagcttgactgtggggccccaggccagagccactgtcagtgccagcgggcaaggccaccaccaaccggagaagctctgggctcaggtcattccgggtgcaccccctccccggggcggcagctgcagggagaacacagaacgcgtgtccaccgtagggaggtgggctgggtgggcaggccccagtgtgagccctgcagggccctggtctcatggatgcacaggtgagccacctcctcactgcctgatcaaaccccagatgggcagatgcctccgcaggcccccagtgggacttggtgccagccagactccagcggctgtttttttttttaactgtaacggattctgtgtgctccacaccctgagggcctggagactggacatgctttgtaactgaaattagaagtcaataaaccgagggccaggtgggtcagtagaatttccatcgtgaggcatcggaggctgctctcggcacatcagccctggctccttctctcatccttccaacccttcaccccagtgagtgggagtttctaagagccccgtgtcctgatgtgccacccttggaagaacaaaaccctgagacaaactcgtattttgctttttttaattgtctctcccactttgcttcctgttcaaacagattatcatgcacatctgtaatccccacttaagcacctaagaccccctctaaaataacccattaatccattcccactcctgtctgctgctattaacatgtttgtcttcgacgcctttggcagctcatccccttcctcaccgggcttatctgccttgcccggcattgggcatcccatccagaggtgggaggggtggcagcctggagccctggaggccagggccacctccacacctctcccatgcttcccagacgccaccctcacactctgctttctgtactggtgaaggagacaggtaagaactgcagatccacctgcccttggccatgggtcagccctgcccacctcaccgccagagccactggtgagcaggaaaggctggggcacctcccctcgtctaccagtaggaaaagagtgaatcccacttccacccacaccctctattccattccaggggatccaaaggccttccgcccctgctgtcctcaagacaggctaaaacccacacccaaagtgggctttctgggccaaccaactatggacacagtacatagcctgcaaagcctccttggacatcagagctgccccagaaccccggcgttcccatagacccgcaaatggggttctatagagcacccactgcatgtccgactctgtctaaagaccgtgggtaacacagaagcatgaggcacagagggtcctcagggagccttcagggtaattgaccaactcacccctaagacaacgggagggagcacatgggctgtgagtgtcttggctgcacacagagaggcctactgttctgccatttcccatcctcatgtcctggaactttccttccatttcctcaattataaaactggggagcaatggctcacacctgtaatcccagcactttgggaggccgaggcgggtagatcacttgaggtcaggagttcgagaccaccctggccaacatgatgaaactctgtctctactaaaattacaaaaattagccaggtgtggtggcatgcacctgtaatcccagctactcaggaggttgaggcaggagaattgcttgaacccaggaggcagaggttgcagcaagccgagatcaccccactgcattccagcttgggcaataaagcgagactccatctcaaaaaaaaaaaaaaaaaaaaaaaaaaaaaaacgttggcactgacatagatgatatctaaggttccttctggctctcaaattgtctgcttctgtaattcagatctgagtggtgaggcatgggtaagacactcccagagtctcagggatgcctggttaagggctggagggggcatggaaggcttcctggcatcaccaggatgcagcccagatactcatgggccctggcacctggaaccatctgctcaaaggcatcacgtggcaacctgatcgtcccatcatcttccaaagcctcagaagagcagctgagaaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtggtnnnttccnnnannnnngncngtnnnnnnntntagttgttgatttagttattgatttagttatgaagctgtggattataaaaaggctggtttgaaagaaggaagccacattctgtgggggcctatgactgacacccctggggagagttgggccaaggctagctggcctgtgagcctcagcagcactgcagggggcctgggagggtgctgagctctgcctggggtcgggggcagcagcggggacctgggggtgctgagctctgagcctgggatagggggcactgcaggggcctggggggtgctgagcnntnnnnnnnnnnnnnngngnnnngcagngnncnggnnntgntnnncnntnnnncnnnnntnnnnnncncnnnnngggnnnnnnnnnnntnnnctntgnnnnnnnngnggggngcncngnnggggcntgngggnnntgngctctnnncctggnnngggnnncncngcngggncctgggggtgntganctctgagcctggggtgggggcactgcaggggcctgggggtgctgagctgtgagcctggggtgggggcagcagcgggggtcaggggaggccgaactgagccccgccgcccgcaggccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccgtgagtgtgtgggccccgggagccccacgccgggtagctccctccttatttaaaaatagaggtcctgagaaaacaaaagaagaaanaccnnnacaaaaaaaaatagaggtcttgtaggccgggcgcagtgactcacacctataatcccagcactttgggaggcccatgcaggtggatcacctgaggtcaggagtgcgagaccagcctggccaacatggcaaaaccctatctccacaaaatatgcaaaaaattagtccggtgtagtggcaggcgcctgtaatcccagctactcaagaggctgaggcaggagaatcacttgaactgggaggtggaggttgcagtgagctgagatngtgccactgcactccagcctgggtgacggagtaagactctgtctcaaaaaatacatatatagagagagagagaaagagagngngnagagagagagagagagagagagagagatcgagatcggtcttgggcctggcacactggctcacgcctataatcccacccctttgggaggccgaggcagcaggattgctggaggccaggagtctaagaccagccagggcaacatggtgaaaccgtgtctctactgcacatacagaaattatccaggcatggtggcatcacctgtaatcccagctactcangaggctgaggcaggaggatcccttgagcccaggagttcaaggttacagtgagctaaccttgcctgtgggaggcaagcaagcttcgattgtaccactacactccagctggggcgatagagccagaccccgactcaaaataaaatgaaaatagagttctagatagtagcagaatatttgcctgtctagggcagcctcttgccatcacctgggagggcctgcctggaagagngtggactctgagcagggatttgaggcacaaagcgataagggtcagccgggagctggccaactagggggaggcccgggccagaggaacagctggcagccatagcaacaggaaggggtgatggccaggcgggggacagctctaggggagtgggggtggaaaaggggctgagggggtaaggagcntcacaagccactgtctcctctccaacagggccagctttgcccccgcctgcctctcccatgagatcatcatccggaggtcagtgtccctgctccgggcagcttgcgtccatgacatcaacttcaaaagtccacatgctccccaaccgcacttggcctcccatgggcctcttcttggcgcttctaggggtgggatttccttataggggtgccagagccacttgtaccaacagctgtatggcaagaattaagactcaggctgggtgcggtggctcacgcctgtaatcccagcactttgggaggttgaggcaggtggatcacctgaggtcaggagttcgacaccagcctggccaatatagtgaaaccctgtctctagtaaaaatacaattagctgggcgtggtggcgggtgcctgtaatccagctactccggaggctgaggcaggagaatcgcttgaacctgggagacagaggttatggtgagtcgagattgcaacattgcactccatcctgggggcaacaagagtgaaactccatctcaaaaaaaaaagaanaaaaaaaaaagactcaggctgagcagtggctcacacctgtaatcccagctactcaggaggctgaggtgggaggatcacttgaactcaggaggttgaggctgcagtgagcagtgatcacaccactgcattctagcctgacaggcagagggagaccttgtctcaaaaaacaaaacaaaacaaaaaaacccaggctagatacggtggctcacgcctgttatctcagcactttgggaggccaatgggggcagatcacctgacgtcagttcgagaccagcttggccaacatagtgaaaccccatctctactgaaaatacaaaaaattagccagtctcggtggcacacgcctgtaatcccagctactcgggaggctgaggcaggagaatcgcttgaacccngggaggcggaggctgcagtgagccgagatcctgccatggctggtctcaaaaaaaaaaacagctgcctcagtgttgatgccactccgcacatgtgaccccctcccccggttttcctctgcagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaangctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaantttttaaaaaaaggaannnannaanntnnnnnnnnnnnnnnnntnntgtnnnnnnntnnaanngattttaaagagacaaaaaagaacctcaccctgcccgcgtgtttatttgcttcacacttcccctcctcctctccctcccctccctcctctccctcccttcctcctctccctaccctcctcctctccntaccctcctcctctccctnccctcctcctctnnctcncctcctncnntncntnccntccctcttctncntcnctctntcnccncctcnncntcnnnnnnnnncccnttcnncctnnnnnnnnnnnttnntnncnctttttncnncnnnnnnccnnnnnntnncnntntnnnnncnntnnctntnncnnnnnncnnnnnnnnncngtnnnnnnncnnttnnnnnnnnnnnnnnntnnnnnnnnnnnntncncnnnntcnnnnnnnnnncnctncnnnnnnnnnnnnntnnnccnnnnnttncntnnnnnnnncncncncnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgatactcatgtggtggaattctttttttgagacggagtctcgctgtgtctcccaggctggagtgcagtggcacaatctcggctcactgcaacctctgcctcctgggctcaagcgattctcctgcctcnnnntcntnnnnnnnnnnnnnnncnggnnnntnccaccacgctcagctaatttttgtatttttagtagagatggggtttcgccatgttggccaggctggtctcaaannnntgacctcagntgatccaccngcctcagnctcccaaagtgctggaattacagatgtgagccaccnacgcccacntcncntagtnttnaaaactctttatcaatccagaacacttcctacccagctgacaattccttaaacatttgcattttatttctttctactaggtcattcctgcacatggttcaaaattcaaaagatgcagaagatatgagggcgaatgcccantttcccccacagctcaggttccctggctctgcttccaagggcaaacagtgttaccttgtnggatattcccagagatcatttcgtgaaaattccggtaaacaggtgcacacgttgacatacatgcatttttttcttttacacagatggctacacactacacactggtgtctcctcctcttgacactgtatttcggggcgcgcagtgagctgccgcaggtgtgacagtccagggcctgcggagggctctgcggcacacgcaggtgcaaagggtgcacgtgcatagccttgtcgtgtggtcatcacgttgcatgagggcaagtatgtctgtggactaaaccccagatgtgggattcctggggcaaaaacatgaagctctagcctgtcaccccagcactttgggaggccagcgtgagatgatcgctttggcccaggaggttgagaccagcctgggcaacaaagggagaccccgtctctaaaaaaaaaattaaaacattagctgggtgtggtgatgtacacctctggtcccagctactcaggaggccgaggtatgaggatcacttaagcctgggaagtcacagctgcagggagcagtgatcgcgccagtgcactccagcctgagtgacagcaagaccctgtctcaaaaaaaaaaaaaaaaaaacagaccaggntgcggtgtctcacacctgtaatcccagcactttgggaggctgagactggtggatcacttgatgtcagaagttcaagaccagcctggccaacatggtgaaatcctgtctctactaaaactacaagaattagcagggntgtggtggtacacacctgtaatcccagctacttngggaggctgcggcaggagaactgcttgaacttggaaggtggaggttgcagtgagccgagattgtgccactgcactccagcnctgggcaacagagcaagactctgtctcaaaacacacacacaaacgtacccatgaatctctgtagttttgataataccaaggtcacaccaatgccagccttgggcatggttgtgggtggagctttctgagcaaagcattccatgccaattgtatgtagccctacgaggtgggtttcattataaacgccagtttacaggccgggcgcggtggctcacgcctgtaatctcagcactttgggaggccgangtgggtggattgcttgaggcncaggaggttgagaccagcctgggcaacatggtgaaaccccatctctactaaaaataccaaaaaaaaaaaaaaaanggccgggncgncaatggctcatgcctgtaatcccagcaccttgggaggccganggcgggtggatcacgaggtcaggagatcgagaccatcctggctaacacggtgnaaaccccgtctctactgaaaataccaaaaaattagccgggtgtggtggcgggtgcctgtagtcccagctactcgggaggctgaggcatgagaattgcttgaacccaggaggcagaggttgcagtgagctgagatcataccattgcactccagcctgagtgacagagcaagattctgactcaaaaaataaaataaaataaaataaatactccagtttacaaagaaacaggcccagagaggcaatgtgaccataagggtcagaggacacggggccacgtcagcctgagcttcacacctgccctgcggccacggctccattcccagagtggccaggaccgtaggaccctgtgccttggggacatgtcctggggtctgactctctgtgccaatgagtcagggctgccctgggcctgagaatacccagacaggactggtgcccgtgggcaggtgtctgccaccccaggcagagccaagtggcctgtccacgatccccctgtggagcactcctatgtggtctctggagggaatccatggagtcccagcagccaatggagacgacaaggtcagagatgtggagaccgagggctggaggtgagagaaggggtccgggggagtctggtggcctccttctcggggcctccagagccagacctccaggcagggccttggacaggactccccacaaggacagagctcgggagggagagggggctggggagcccgaaagaggcctggctgtcaccctgtctggggagactttgctgggacccctgccgtgctgtgggagctgggggagccacatgcgaggtgctggctcttggccaactctggcttgagcactgcagtctggcaggcgtgatgtttgctcctctgaggtggctgaaagggacctgagggcggatggtggtgtgtgtctggggggaccaggctcactgaacaggacacttgtgggttgggcccaaagggatttcaccgacaaataaaccnctttcttcccacatttgtgccgaaagagaaagaggcgcagctcacctaatggtcaatcggtcaatcgctgccatgctgtcctgcaggnaccagggnacaaaacgagccctaggacacgaagaggacgctggcctgtagctccgcagtgacggtgaccccaggctgtcctgcaggaccagggacaaaacgagccctaggacacgaaganggacgctggcctgtagctccgcagtgacggtgaccccaggctgtcctgcaggaccaggaacaaaacgagccctangacacgaagaggacgctggcctgtagctctgcagtgatggtcaccccagcttgtccacgctgacttctcacctttcccaggacggttggcgcctttcattnctctggggcgaaaacagtcaggacattcatnccaacactgagccgtgtctcttccagcagcgatggccaaggcatagcctttgctattcagggactgaaagcagggaacttccactgtgtgacaacattacaaatttaaactctgtacttaaaaaaagaaagccagctgggnncgtggtggctcacgcctgtaatccncagcactttgggaggccgaggcaggtgaatcacgaggtcaggagattgaaaccagcctgaccaacatggtgaaactctgtctctactacaaatagaaaaattagctgggtgtggtgctgcgtgcctgtnaattccagctacccaggaggctgaggcaagagaatctcttgaacccaggaggcggagattgcagtgagctgagatcatgccactgcactccagcctgggcaacagagcgagaccccatcttcaataaataaataagtaaaaataaaaatatttgttaacgtttgtgaatgtataccacagcagcaacaagcgtgcctggcccccatgtcttggtctctgatgccattcccccaacacaanggaaccangttcctgggagacacggctgactccagggctgggctggtgtctgagacaggaaaaaaaaacagtgttttccctgctctcacacactcaacagtcaacatccaacatggaatacttcatctctggtcaccaaaatgtgtgtggggattttccccaaacaccaagcaagtctccagtggacacctactaggcatcctccaaccctgctccagcgagtctccgcaggcacccactgggtgtcctccaaccctgttccatccagtctccgcggacacccgctgggcgtcctccaacccggttccatccagtctccgcggacacccgctgggcgtcctccaaccctgttccattgtgacgctttctccctggagacagtacccgatcctgcaggctaaggtctcagtcccacaagagtgtcctccacttcagatgccagtcccaagtacagctgtccctttgtatccttgggggatgggatccagtacctccaaaacaccagaatccacaaggccagagtccctgatacaaaatggcatgttatttgcatataaccccctcctctggacttaaatcacctcttgattacttataacacctggtatgtaaattctatgtaaacagttgttacatagtattgctttttaaatttgtattatttgtattattattactattattttgagatggagtctccctctgtcacccaggctgaagtatagtggcatgatcttggctcactgcaatctccgcctcccaggttncaagcaagtctcctgcctcagcctctggagtagctgggattacagtcacataccaccaggcctggctaatttctgttatttttagtagagacgggatttcaccatgttggttggtcaggctggtctcaaactcctgacttcaggtgatccacccacctccgcctcccaacagtgctggatgtacaggcatgagccactgcgccntggccttatttattgttttatttatttattttttgtattttcttttgagacggagtcttgctctgttgnncccaggctggagtgcagtggcgcgatctcggctcactgcaagctctgcctcccgggttcacgccattctcctgtctcagcctcccgagtagctgggactaccagcgcccactgccacacctggctaattttttgtatttttagtagagacggggtttcaccacgttggccaggatggtctcgatctcctgaccttgtgatccgcccgcctcagcctcccaaagtgctgggattacaggcatgagccaccgcgncccggccttttcttcttttcgagactgagtcttgctctgtcgccaggctacagtgcagtggcacgatctcggctgactgcaacctctgccttccgggttcaagcgattctcctgcctcagcctcccaagtagctgggactacaggcacccaccaccacgcccggctaatttttgtatttttagtagaaatggggtttcaccatgttggcctggctggtctcaaactcctgacctcaggtgatctgcntgcctcagcctctcaacgtgctgggattacaggcgtgacccaccgcgccgggcncangtattttttgtattttcagtctgaggtttgttgaatacttgggtgtggaacctgaggacagatgaccaaatgtagcaggtgtcacccgccctctggccaaccgaggttcccatggcccctcctccagttttgtgactttgctggagtggctcacagaactcagggaagcactttcctcattttattatttattgatttacttttggagatggggtttcattgtgttgcccgggctggagtgtgacggcataatcacagttcactgcaccctcaacctcctgggattaagcagtcctcccacctcaacctcccaagtagctgggattacggatgtgcaccaccacgcccaactcattttttttttttttttgagatggnagtctcactccgttgcccaggctggagtgcagtggtgcaatctcagctcacggcaacctcggtctcctgggttcaagcgattctcctacctcagcctccccagtaactgagattacaggcatgtgccactacacttagccaattttttttttttntgagacagagtcttgctctgttgcccaggctggagtgcagtggcactatcttggctcactgcaagctctgcctcccgggttcacgccattctcctgcctcagcctcctgagtagctgggactacaggcgcccatcaccacgcctggataattttttgtatttttagtagagatggggtttcactgtgttagccaggatggtctcgatctcctgacctcgtgatccgcccaccttggcctcccaaagtgctgggattacaggtgtgagccaccgcacccagccaatngtttttttttttttaaatatagacagagttttaccatgttggccaggctgntctcaaacccctgaccttaaatgatctacctgcctcggcctcccaaagtgctgagatgacaggcgtgacctactgcgcccagccaattttcgtattttttgtagagatggggtctcactatgttggccaggctggtctggaactcctgagctcaagtgatctgcctgcctcagcctcccaaagcgctgggatgacaggcgtcagccaccgagctccgccaacactttatttatgtttccccatngtgtgacaaaggacccagatgaacagcagatagaggcaatgctgttcatctggaggcctctccagggagcttccaggaccctccaagcattccgccacctggaaacctcccaaccctgtccttttgggttttatggagacttcattacgtaggcatgactgattacatcattggtcactggtgatcagctcagccttcagcccctgtccctcctggaggctgcaagtggggctagaagctctgcccttctgatcacatagtagctgccaccaaccccccnnacncccaaggctgtccaggagcccaccaggagtcgcctcattagaacaaaagacgctcctgtcacccaggaaattcaaggggattgggagccccnatgtcagatgatcctatgggttaggagattataaaggttttaggagctctatgtcaggaaccggggntcaaagaccaaataccacaataaaagactcctcctgcctctgtctgaaagggtcttagaagttctgtctcagaaacccagggcagagattcagtaggcatttctttttctttttctttcttttttttttttgaggagtctcgctctgttgcgatctcagnctcactgncaagctccgcctcccaggttcacgccattctcccacctcagcctcccgaggagctgggagctgccctacaggtgcgtgccaccatgcccagctaattttgtttttgtatttttagtagagacggggtttcactgtgttagccaggacggtctcaatttctcctgaccttgtgatccgtcttcctcggcctcccaaagtgttgggattacaagtgtgagccactgcgtccggcccttttttttttgagacggaatctagctctgtcacccaggctggagtgcaatggcgtgatttcggctcactgcaacctctgcctcctgagttcaagcgattcttctgcctcagcctcctgagtagctgggactacaggcacgtgccaccacacctggctaatttttttgtatttttagtagagatggggttncaccatgttagccnggatggtctgnatctcctgacctcgtgatccatccacctcagccccncccaaagtgctcggatngcaggtgtganccaccgcgcccngctgnatttangtttttntaactnaaaagtccnggaannncntncnnnnatnnnnnanangntnnnnnnnntgnntnnnnnnnggnnnnnnannnannngnnntnnnnnnnnnnnnnnnnnnnanngggnanncnnnnannnaatatcccggngtattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnttnnnnnntnanannnnnngnnnnnnnntnnnnnngnnntcagnnnnnnnnnngnatgctgctgacaccctgagccagggaaggcacaactgaccccannaagaaagaaaaacttccacatgaagaatgacgtgggnggggcgcagaggctcacgcctgcaatcctttgggaggacttntgggaggccgaggcgggtagatcatgaggtcagcagttccagaccagcaggccaacatggtgaaaccctgcctctactaaaatacaaaaattagccgggtgtggtggcgggcacctgtagtcctagctactcgggaggctgaggcagaatggtgtgaacccgggaggcggagcttgaagtgagccgagactgcgccactgagctccagcctgggcgacagagcgagactccagctcaaaaaaaaaaaaacatgagatgctcattttcagttgccagttatcaaaaaacaggaagctgtttgggcccaacccagggaaggcagaactggtgctaagactcatgtccctccttccccagcaccccccactgtcccgtcccccgtccctggccagctgaacgatcctgtgccccacacagtcagcctcccccagagcacgacccaccatgttctcaggcccctcacggctccgggaagcgggcaccatctccagcttggcattgttgggcaggttggcaaatctccactggangagaaaggtcgagcacgctcctctgaaancctgcaagacagaccagagcacacttgctgccctgcagagcctgacacgccctgccatccacgccccgccatccccgtcccaccatccacgccccgccatccacgccccgccatccacgtcctgtggcagctccccaacagcgggacgtcatgacctgcagaggcacaaggcgggtccccgatcatatggggcctccntgcaagcagaagggagcaggaaaaagggagatgtgggcctcggtgcacgccgagggggctgctccttcagagtctggggtgctgacagccccagtgcagacgctcggaaaacacagagagaacgactggggcgtgaacactgctgcactcgcggaagctggagtgtcacagaccccggccgtcacggctggagccaccacagaaaacctgactgcccgggcgcagtggctcacgcctgtaatcccagcactttcggaggccgaggcaggcggatcacctgaggttcaggagtttgagacaagcctgaccaacatggtgaaaccccgtctctactgaaaatacaaaaatatcccatctctactaaaaatacaaaaaaataagctgggcatggtggctcaggcctgtagtcccagctactcgggaggctgaggcaggagaatcgcttgaacccgggaggcagaggctgcagtgaggcaagatcatgccactgcactcctgcctgggcaacaagagcaaaactctgtgaaagaaaaaaggaaaggaaaggaaagaaaagaaaagaaaagagaaaggaagaaaaagaaaaagagaagaagaaagaaagaaagaaagagaaaacaagaaagaaaaagaaagaaaagaannaagaaaaatctgaatatactcaaagtggttggcctcactttggaaatgcaagctgctgtcggagacaactagtgaagagagttcagacagcccaggggcatctggaagaattaagagagaacaaactttgctatatcaacactggccagaaaagtgagtctggaaattgccacatgaaatgtctacgtcaagacaggatagcagatcgggggatcccgagggcaggcaggctgggaaccttggagcggagggcactgttcacgcctggggctgcattcctctgcaccggctgcactttgtaagcaagtggtaccattagcagaggaaaagggcacctgaaaacatggctatggtattgcaggacctgcctcaaaatcgcactcactggttcccaccagacaccaccacacagaccacgggcaggtgaacactgagaagtaacaatgcgctgngngcgcggtggctcatgcctgtaatcccagcaatttgggaggcccagacgggcagatcacttgaggtcaggagtttgagagcagtctggccaatgtggtgaaactccgtctctactaaaaatacaaaaattagccaggcatggtggcacaggcctgtagtcccagctactcgggaggctgaagtgggaggagtgcttcaacccgggaggcgngaggntgcagtgtgccaagatcgcgccattgcactccagcctgggcgacagagcgagactccgtctcaanaaanagaaagaaaaatgaggccaggtgcagtggctcacgcctatcatcccagcactttgggaggccaagacgggcggatcacttgaggtcaggagtttgagaccagcctggtccacatggtgaaaccccgtcactactaaaaatacaaaaattagccaggcgtggcacgtgcctgtaattccagctactcaagacgctgaggcacaataatcgcttgaacccgggaggcagaggttgcggtgagctgagatcatnccactgccctccagcctaggtgacagagcaagactctgtttcagaaaaatggccanncacagtgactcatgcctgtaatcccaacacttnggaagaccaangcgnnnnnancacntgagnnnnggactnnaanaccagcatgaccaacatggtgaaaccccgtccctactannaatacaaaaattagctgggcatgatggcgcacncctgtaatcccagctactcgggaggctgaggncanaagaatcacttgaacctgggagacagaggtntgcagtgagccgagatagcgccactgtactacagcctgtgtgacagagcgagactccacctcaaaaaataataaaataaaaaagaaataaaaatgaaaccctaagccccccccaancaactgaaccagcctcctcttggcccaggggaccccagaaaccttgaaagctgagttnctggccatggctgggtgggagatcagacacatctgcaggctctcttccctaagggataaacngaaagcagccnctttccnaagacccctgggctggtatctgacatcagccaacctcccgccaggcccttctctncttgcnggtttcttcaaaacaacccacaggtatttcctgataagaaaccaccaaccatggagtggttctggcacagtcagggttttcgtggcacagtcttcatgtcctctgatttgccatttatttatttatttacttatttactttttttgtagagacagggtctcactatgttccccaggctgatctcgaattcctgggctcaggcaatcctccgcctcgggcacccaaagtgctaggattacaggcatgagccacttcacccagcctgcttcacctctgacttcagaggccaaaaattccaccctcaggtcatgctggcactgccattttttgcacataggacccgtgaaganggcaggaagctcaactgtgtgcacagttctcctttcatgaantactcatgatcctcctacagcgtattaagtacgtctgtatcagccaccccattcggtgtaaatccctgtcttattcttccctctcttgaagtgtctgtttccagcttctggctggaggctacacttcccagcctgttagaatggccaccctgcaagctgcaaccggttatgagaaataaagccctcctttccaaacatatgaaccgcattcttcagttgacaagagagactggagaaggatggtgtgaaggtctggggcagaaagcccaagaccacctggcattcagagcacaggtcctgggnattctcacgtggtccagancacaaggtagaagactggaatgacttggcaggtatcacccctaagaaactcctcccaggagagcctcgtaaggcagggtgggcaatgccaggagggcaagctcctgcccntctgcccccagtgttaggnacaacagtactgtaaaaacaggtcttcaagggcaggcatggtgactcatctctgtaatcccagtactttgggaggccaaggcaggcggatcacaaggtcaggagttctagaccgtcctggccaatgtggtgaaaccccatctctactaaaaatataaaaattagctgggtgtgttggtgagcacctctaatctcagctnactcgggaggctgaggcaggagaatcacttgaacctaggaggtggaggttgcagtgagccaagaccgtgccactgcactccagcctgggcgacaagagtgaaaccnctgtctcaaaaacaaaacaaaacaaaaaaaacaccagnaaaacaggactttaaagtgaaaagcttcgcgtgtgggatagacacgcacatcctatccatatgagggctctgacccttctgctgtctcagactccttgagagtctggcagaagccctctcttgggaacaatatccccacacagaagcgtacgtgtaattccaggggctgtgagactgcagggatccacctgcagttttcaaggcatcctatttctccacggccagctctttcccctcagagccccactgggaacttatgcaactcaatgcaataaaacctacagggggttgaatggtggcccccccaaaaaagatgggtcaatgtcctcacccccaggacctctgaacatcttactagggatcctggtctttgaagnatgtaatgataaatcgttctagattatccaagtggaccctaaatccaatgacaagggtcttcctgagacacagagaaaacaggaaaaggccacaagaaatcggaggcangagagcaatgcggccacaagccacagaacgcttggagccatgagaagctggaagaggcaggagggattctcccttagggcatttggagagangtgtggccctgccaaggccttgggtctccagagttgggagggaatatatgactgtttaaaaccacctgggggcttttccaagtgagagccagtatgttcagggggcaggggcacagatatactcagaccctgctgctgagctggagcaaactcacttcagatcatattcacaggggttgaagtcctgccgccggcacgtgtcctccagaacctgggggtgagatgaaaggatggtgaactgctgagtgtgcagggctggcgggcgcagtgggccaggtcagccaagggcattcagcttcctggtgagccaggtggctctgcccaggcaaagccaagcacaagaccacactatggacggtccccgcaacaaatgcaggctctcacctgcaaatncctgtccactctccctcccttcttncaccatcccctcagttttgtaggaaagctccactcagagttcccctgcagtacagcaacacgggcatcttcctggcacacaccctgggctctccttcaaaccctgtagttctgcaacctgccttaaacttgcctagcacaagctaccccctggctctggcacggttctgtgcacctgctgccactgcctgcaccgcctccgcccctcttctccataaaaagccaaagccgtggccttgcaccaaggggtcccgcgcagcctctgcgggagcgccccacttccgcactctgcacgcctggcaccaacagcctcctggctgcgccctccacctgcccaggcctggggaccccacgccgtgggctgctcccgcaaactccgagtcgtgtgcaccttcggatcctcacggtcccccacgcagcagaggctcaataaatactttttttttttttttttgatatggagtctcgctctgtctcccaggctggagtgcagtagcgcgatctcggctcactgcaagctctgcctcccaggttcacgccattctcctgcctcagcctcccgagtagctgggactacaggcgcccgccaccacgcccggctaaatttttttgtatttttttagtacagacggggtttcaccgttttagccaggatggtcttgatctcttgacctcgtgatccacccgcctcggcatcccacagtgctgggatttacaggcgtgagccaccgcgcccagccaatacttttacatttaattgattcgcggtcacaaggtgcccaagtaaaagtgcagtgagtgactcggcaaaaatcgcttccaggccccacggccgggacatctgccaccgcgcaacccgggctcccgctccgggggacgccccggaatgggaacgcgggtctagggctccactcctccctcttcccggcgccctcgcgagctgggctcggccgggcgccgagtactngatgcgggtgacacgcggcgccgttctacctcacccctggnaaggcnnnnnnnncnncnngnnnnnnctcnnnnnnnncngggacccccnggancccagcnggaagcgcaggtgacgncgagcagggggcggggcncgccnctcaggaggccgctcattggccgccgaggccccgcccccgaacaccgggacgccgaccgcaatgggcggggcctcggcgcagcgccccccgcccgcctacccgtccgccccgggcgggcggccgcacctgaagcagcacggtgctcggcgtcaccttcaccgtgtggcgccggccgttcggggccagcaccgacaccgcggagcctccgccgcctgccgggncngnnnnnnnnnnnncanntnncncnnnnccgggccggcgtcaaacaactttatcggcaacagncaggacgcgcagccacgcggccagggggcgggnccgcagcgcacttccgggtcctgccaggccccgccctttccccacccacggcgcccnggcnccgcccttgggccgccaaagcccgcgccagacccggaaagcgcggtcgtcctctgcctccgggaagcgcggcttggatgggctcgccggggccaggctgggccggggctgggcgcgcggtcacccccggtgagcggcactgagcccnggggtcccagcggtncgcgctcgcccacnctcgcttcgtccctgacacgtccccagctcggtgccctgctctcccccgaccctcccggcttcctccactccagcagctgagcctcttccctgcccacctgtccctgtggtcagcgtccacctcctgaccttatggtttggggcagtccccccgcccctgtacggatcctccctgggtgttgggactcgtggccctcagtctagacctgatttctttcatcctaaaatgggagtgcagaatctggcagccctagggctgccgcgacggtccctaaacctgagggtaggaaaggcgggagaccggtttcagaaccgtggggtgagcgaacttgagtctcaccggagctcctgccgacccacaggcactcaaggacttcccgcaccaacccatgctgaggaggggcttggtggcagcctcaggaaacactcccatcgccagccaccgcagcagggaaagcacctggcctcaccagctccaggcttccagaaggagctgccctcctgactcgcagccgtcgaatgtgcttagctcccagcacctgggccactcatggacagcactcgcacgtgttccgccccgccccccacctccatggctcagccgggccttggcactcctctctccatgtgcctgccntgtctctgcggactcctggctagggctcagctgcccagtagcctgtggaagggggaactggtgcagttatcagtcaatcctcccacagggctgggattacacacgtgagccaccgcacccggcagtcattgctgagtctaaggacatctctgcatgggtgctgttgtgccttcctgtcgatgacatatnccatgtcacccacacacacctgtatgctgacaaacacggacatctatgtacattggagaaacctggggaaagccccaggctagccatagccctcccatccagccagccagtcccatgctctgtgcaacctcagaaccttactgagccacacatcacctggtgggttttaattctttagtggcgtttttgaagagtctgttcctattttccttagactgtcccacagtctggatccttggttaaacgtttggggcaatgatgaagggaggtgacaagtcagcaggaggtgcaggacatcagcgtggccatgagtgaggacgtgaagttgaaccacttggtcagctttgggtctgctgaattcctccatggtcaaggtccgtggctccttgtggagtaattaaggcatgcgtgaggtcattctctgagaccacaagcatcaagttttcccaataaccatttgcccaacagttttagcatcagttaatgagtagattcagtgttaaaccgtaaagctgcaaaatcatggcttcccaagtttattgtttcttctacatttatagtcactttcggtcaagcttccccttctttaaaaagttattaaatatttgggnaggctgaggcaggagaatggcgtgaatccgggaggcagagctcgcagtgagctgagatcacgccactgtactccagcctgggagacggagcaagactctgtctcaaaaaaaaaaaaaaaaaaaaaattaaatatggccaggcgcggtggctcacgcctgtaatcccagcactttgggaggctgagttgggcagatcacaaggtcaagagattgagaccatcttggccaacatggtgaaatcctgtctctacttaaaaaaaaagtacaaaaattagccgggcatggcggtgcgtgcctgtaatcccagctattcgggacactgaggtaggagaatcacttgaacctgggagatggaggttgcaacgagccaagatcgcaccattgcactccagcctgggcgacaagagtgaaaccccatcttgaaatatatatatttattaatatgaattcatgtatttttttcattcagtcagcattctttttgatgctcaaattggtccgaatttggccagtgagacctcctttaagctggctcctatgctttttttgataggangggatgatcttttatcctgatattatttcaaacttagccgagcaaggtggctcacacctgtagtcttagctactccggtggccgaggcaggagaattacttaagttccagccttagtgaaccactattcatgcctatgaataactactgcaccccagcccgagcaacgtagtacgataccgtctcaaaaaaggagaaggagaagaaagaagaagagggaggaggaaggaagaaagagaagaaaagtttgcaaaagcaagaattcctgctgtatatctttttttttttttttttttttnggagantggagtctccctctgtcgccaggctggagtgcagtggcgaaatctcagctcactgcaacctctgcctcccgggntcaagcgattcttctgcctcagcctcccgagtagctgggactacaggtgtgcagcaccacacccagctagttgttgttttgttttgttttgntttttgagacggagtctcgctctgttgcccaggctggagtgcagtggtgcaatctcggctcactgcaagctccgcctcccgggtncacatcattctcctgcctcagcctcccgagtagctgggactacaggcacctgccaccatgcccggctaattttttgtatttttagtagacatggggtttcaccatgttagccaggatggtctcaatctcctgacctcgtgatccacccgcctcagcctcccaaagtgctgggattacaggtgtgagccaccacgcccngnctcctgtanatcttttanccngataaatcngngtttacntgtcaccccnttngtntnannanatnntcnnnnnnnnnnncnnnnnnnnnnnnaaaannntttntnnnnnnnnnnannngnnnnnncnnannannnnnncncnttnnnnnnnnnnnnnagnnnnnnnnnnnnnnnnnnnnnnnntgnnnnnnnnnnnngnnnnnnnnnnnnnnnnnagctctacaaaaaatacaaaggttanctaggcatggtggcatgtccctgtagtcccagcgatttgagagattgaggcaggaggatcacttgagcccaggaggtcgaggctgcagtaaagacattgagcaccttcgccactaaatacttcagttttnctcttncctaagannannnncnnnnnnnnnnngnngcagtggctcacgcctgtaatcccagcattttgggagaccaaggcgggtggatcacctgaggtcaggagttcaaaaccagcctggccaacatggtgaaaccnctatctctacaaaaaatacaaaaagtagctgggcgtgatggcaggtgcctgtaattccagctacttgggaggctgaggtgggagaattgcttgattgtgggaggtggaggttacagtgagccaagatcacgccattgcactccagccttggcgacagagtgagactcagtctcaaaaaaataaataaataaaataaggccagtctcttatatagccaccataatttcatacaaaattgggaaatctaatgttggtatcatactctgagttaatccacagttaattgtccaagtgtggacatctttcctgcatccttttggcatttccattattctttgggcatctcctctctgcccnagccctgaagtcagccatttttcagagaaaccccaatcccttttacaaggaaatgggatttagagaccaagttctgggtgctgagtgtgctcatggctactgngatgtcactgctttctgggccctctcaggggacacaattagntgtgatgaattcatctgaatatttctaagccacacctcagccttctcccccttcttccctcattccatatttgtatttggttgaattctattaaattgccctagttaacctttttttatcttctttttttttttttttgangacggagtctcactctgtcacccangctggagtgcagtggcgcaatcttggntnantgcaagctccacntcccaggttncacgcnnttntcctgcntcggncctccngagtagctggnactacagncaccgnccaccacaccncggnnaattttttgtatttttagtagagacagggtttcaccatgttagccagaatggtctcaatctcnnnnnnnnnngatncgcctgcctcngnctnccnaagtgctnggatnacnngtgtgagccaccgcancnangcntnntnnnnnnnnnnnnnnnnnttttttgagacagagtctcgctctattgcccaggctggaatacagtggcacgatctcggctcagtgcaacccccatctcccgggttcaagcgattctccttcctcagcctcctgaatagcttggattacaggcgcttgccaccatgagcagctaatctttgtatttctagtancnatggggtttcactgtggtggccaggctggtcttgaactccagacctcaggtgatcctcccacctcggcctctcaaagtactgggattatagataggcatgagccactgcgcccagccgatcatttttgatctacaaaaaaatgacaaaacctacatggttcaacctaatacctcctttgtccgcagtgagaaccctaattgtcagtaaatcagtatatttattcntttgctttgttctaaaatgccctccnaatantttcanaggtactgcggcnatcttgctattaacaacanatctactgtggaaatttcaagatgtctttgtagctatttttgtcctttagagtatgtcccattaaagaaacatagagtattgtgttcaaaagttattngaattaantngcttttctgtgttanggtnnnntnnnnnnnntnnnnnngtnnnncnnnnnaacagaancnatnggatatgcncagatatatacaanangancancctggcnaacatnngnanncnnnnnntnnantnnnnanacanaaaatagccgggtgtggtgctgcacacctatagtcgcagctactcgggaggctgaggcaggagaatcacttgaacccgggaggtggaggttgcagtgagccgagatcacaccactgtactccagcctgagtgacagagtgagactccatctcaaaaaaaaaagaggaaatgtattatgggaattggctcanatgattatagaggctgagaaagaagtcccatggtcggttgtctgcaagcttgagacaggaaaannagnnnntnnnnaaccagtgnatanctnnatactcnaaccagtgtatanctcaataccnnaaaccagtgtatnactcannacatnggtntatnatataatnacannatanttnanttnnatccaagtctgcaggtctgagaaccagnggagcgagangtgtaactcccatcctgaagccccagaagtgtaggatgggcggctggtgtaagtcctggagtccaaaagcctgagaagcaggttgcccttctccaatgtccaagggcaggaggatggacgtcccagctcaagaagagagaatgtgtccttcttccacctttttgttctatttgggccctcaactgattggatgattcctgcccgctgtggtgagggtggatcttcttgggccactgatccaaatgctaatttcttccagaaacatccttgaagacatacccagccatgaggttttaccaactctctgggtatcccttagcctggntcaagttgacacatacaattaaccattataggtaggttaggtccgtttaacaatttgatgcacggttaggttacatttatttattttgttttttactaaatttggggttttttcttcatccttttttatagtgctatattttcattgttcaaaaggtttatttgattcaggtgcggtacggtgactcacgcctgtaatcccagcactttggaaggccaaaacgggtggatcacctgagttcaggagttcaagaccagcctggccaacatgatgaaacaccacctctactaaaaatacaaaaatcagccgggcgtggtggtgtgtgcctgtcatctcagctactctggaggctgaggcaggagaatctcttgaacccgtgaggtggaggttgcagtgagccgagatggtgccgctgcactcacactccagcctgggtgacagagcaagactccgtctcagaaaaaaaaaaaaaaaatctacatatgtgcccacctggcacctgacacaggaatttgctcatctttgcaaaaagaaaaacnagcaggctaccctagaagttaacgaaaatggttttcttggccgggcacagtggttcacacctgtaatcccagcactttgggaggccaagatgggcagatcacaaggtcaggagtttgagaccatccggancnacatggtgaaaccccgtatactaaaatacaaaaattggnccggcgtggnggtgcacanctgnaatcccagntactgaggangctgacacagnagaantgcntgaacccangaggcgnangntgcagtgagccangatancacnactgcannnnnnnnnnnnnannannnnnnnannntgtctcaaaaaaaaaaaaaaattggccgggcgcagtggctcatgcctgtaatcccagcactttgggaggctgaggtgggtggatcacaaggtcaggagatcgcaaccatcctggctaacatggtgaaagcccgtctctactaaaaaaaaaatacaaaaaaattagctgggtgtggtggcgggtgcctgtagtcccagctactcaggaggctgacgcaggagaatggtgtgaacccaggaggcagagcctgcagtgagcggagatcgagccactgcaatccagcctgggcaactgagtgagactctgtctcaaaaaaaaaaaaaaaaaattagccaggcgtggtggcgtgtgcctgtagtccaagctactcaggaggctgaggccggagtttgaggctgcagtnnnntntngncnnnannnngcnnnnnnngnnnnnnnacagagcgagactccatctctaaaaagagaaaaaaaagaaaatggttttctatgaggatgagngggagaagaaacaggtcaggccatgtctttatactttggaatcaaatatatatatatatatatgtatatatanatatgtatatatatgtatatatatatgtatatatangnatatatgtgtatatatatgtatatatgtgtatatgtatgtatatatgtatatatatgtatatatgtatatatatgtatatatatgtatatgtatgtatatatgtatatatatattttgactgagtctcactctgttgcccaggctggagtgcagtggcgtgatcgcggctcaccacaacctccacctcccgggttcaagtgatccgccgacctcagcctcccaaagtgctggaattaccggcgtgagccactgcgcccagccagatgtagattcttaacctatcttcctccttatacaacaggtgaccacaggatatcacagtctcttttgctgttatcactgcagcccacccacgttttcaaagatttacgcatgaccccactctgcggccacctatgactccactcttctccaccatgcactaagtcaaaagcacaaagtgctcactgctggacattgcatgggaggccacagtgtccaggcgtggaatggtccaggcaccaggtccagccccctacctgcaccgaactgaactttgacctggtctgtgctggcctccaacatagagcctcgcctgcccaggcctcagatcctcacctgtagcaccctccaggcaggtgagtggaccctgacttggcacaggaaggccaagaggtcattgcaggcagtgagtccccggtgggctgcaggaagcctgagccaggccagaagatgagtttgggttcctccnccgaaggctgcacaaagtcaatcccagggctggcccaggcccttgccaggncccactgaatgcccagcacaggggctgtcttctgcctggctttcctgtcttcccttcccctgtcaccctgtcagggagctccttgaacagctacttttcagcatctgcttcctccagaagacaagccctgcaaaggtgcacctgccatcccggccccatgtccccgtgcctgggacagggctcaggcaaatgaatgggaggtggtcagggaaccttcctgtggctcatggagctgcctcacttccagcctcagtcagtggcctctaggcaggacagacacctgggcaggttcacaatcccacctcagggccaggcagggtgacatgcggctgtaatcccagcatctagggtggctaagggggaggatcacatgagcccanagaggtcaagaccagcctgggcaacatagtgagaccccatctctacaaaaaaaattaaaaagtaaccgagtgtggtggtgcaagcctgtagtccaaggtactcaggaggctgaggcaggaggatcacttgagcccgggagttcagggctacggtgagccgtgatcacaccactgcagtccagcctggcaacacagagtgagaccttgtctctaaaaataataatcataaaagaatcgcagctcatacataaatgngnnnnnnnnnnnnnnntatntnnnnnattaaacgaatctagtttctancnnnnnnnngtcnnnnnncttgggaccttgtcagcctcagttctaagggcggcatagtgctggttcttcttnnnngtnnnnnnncntcncnnntttnnctagttnttttttnttgttttttttttttgaggcagagtctcactctctcaccnaggctggagtgcagtggcgtgatctcagctcactctaacctccatctcctgggttaaagnaattctcgtgcctcaacatcccaagtagctgggattacaggcacgcgccaccaccatgcctggctgattttttttttttttttcatcccatgagttttctttctgtaatgatttttgtgtttttagcagacagggtttcaccatgttggccaggctggtctcgaacttccgacctcacgtgttttccctgctttggcctcccaaagtgctgggattacaggcttgagccaccgcacccagcctggttgaactagttctaaggagcaactgcagccaggtctggagagggctcggctgccaccttccctcccagacagcagctagacagctgctcccaggatctgctttgaattaaaagtggcgtggccctttaagagaagcatccgccggccgcccccgccgccgccgcccctctttgatgtcgctggcgctgaaaggttccncagtggcaagatctgagggtttgtttctgcctccccagaggccacgtggggatcacagggagggagggagggcgagcgaaggtcacatggcctccctggcctgctgccgctgttgcggcaggagcaggagcgtggggaccagcaggctggacgggtgggggccgcggcctgcagctcgtgagggcggtggagcctggcagctgggagggcaaaggaccagcctctctgcccctccccttggcacccgggagcctgacctccagcctccctcacctgtccaggaaggagccacacactgtctgcgtgatgtcccaagaggcggcatctccactgatgagctgggactcccccatccccatgcccttcctcccccagctttggagggtggcctttccctggtggccctgccnactccatggttagcccagtaggctgcatgttggcaccagccgggtgaagccgtagggaggaggcgggatggggcggagctcagctgcaggggtgccaagaggggcangatcccgccaaatacctgggtccaaaaatgacagcctcggcctccccgctgggctctaggagctctcacctgggtgaaggacatcctagggcaaggccgatcctttccancaggnaatccagaggccactcactcccaggcactggggccagggagagggcagccncaacaccaagcccaggagcagccgccccgcccaggggcccncctcgcccctncaangacctgggcgagagccacagcagctcctgacaagggacttggctcatcnaggtcnnangnnntnannnnnngnnnnnnccttctgatggatggggtgaccagaaaaggaggttnggngggaaaccaaaanggggccatgctctgcgacggcaccgcctggcctcggcacctcccccactctgagccggttggagagcagggcctcccccaagagccagccaagggggaagcggcggcctcccccaacagccagccacatggggaagcgggtggcccgcctcacttccctgctcacttgggcctcagaggccagcagctggggcgcagggcagcccaggnggccaggcggggcggggcggccgaggccnnnncnnnnnannnggnnnnnnnncgnnnnnnagcagctggagcccagagcggccctggcgctcaaggccctggggggaggggcccgggatgtgcggcagggagccgcctccagtatggacaaggaagccgggtctggggctgcctgacatgctgtgtgctggacgctcatatcaccaagttccagggccccacgcgaggtctcgaggggacccctgtaccgccagctgccctccatcacaccttnnnncctntncgactgcgcctgcccgccagcttgggcccttgcttcctgaaatgtgctgtcttgaccccntttttcccangggggggggctccggccccccagncancagccgtgaccccggcggattgactcagaaccacctgtgcatccccagctccctccccaggggaaggcggtgaacagaanccctcaccccgtcctgtctcggggntgcctctcctgaagcacagagtcccctctgggccttcgtttccccagctttcctgccgcggggcacacagagtctaggctcagtcagaagccccggcgccacctgaatgggagcctggggaaccctgtatggtcctccctgaacaggacagtggggatggggcagggccagggaagcagagaagggcacaccctgtgagggacaccacacgcaaccatgcagcctgggatgggcactgtggtgctctcgtcgccaggcccccatgtctgccctcgcagtcaaccttggtccctgggggatcgcctgcaatcccacgacgcctgggcagcataactgtcatttatcacatggtcatcgccggagacgccgagcggagcccccaaacatcctgcacctttgatgttcacgcggactctgtgaggcaggtgctgttctcatcccgttttacagacgaggaacctgagacgcaactgcaggccccgcagcagccggtacttggctgtcntaacccatccgctntggtgcagacaaagtggatatctgtctaacatgcaaaaggagggttntgaaacaccctacctgccaggaaggtttctagagaggagccggcccactccaccccaagctggccactcncgctcacggggcctcaggcctcatccccgccacntggtgccctgtgcccagcctgatcgttgttggtcttacccactgattcttttagatggaagcgggntcttgctgtgctgcccaggctggtctcgaacccctgggctcaagcaatccttcttccaggacttnccaaagtnngctnggganttacaggcgtngagccaccgtgcccagtcagaactaactactttaaaatatcagggtgggtgccatggctcatgcctgtaatcccagncactttnggaggccaaggcaggtggatcacctgaggtcaggagttcgagatcagcctaacatggtgaaaccccgtctctacttaatacaaaaaaaaaaaaaaattagctgagcctggtggcgcatgtctgtaattccagttactcaggagtctgaggcaggagaatcgcttgaacccgggagggagaggttgcagtgagctgagatcgagccattgcactccagtctgggcaacaagagtaaaactccatctcaaaaaaaaaaaaaaaaaaatctaatcacatgacagagtacattcagaaaattgtgcaaccattaccacaatccattttagaacattttaatcaccccaaaaagaaaccccgtaccagctgggcacagtggctcacgcctataatcccagcactttgggaggccgaggtgggtggatcacctgaggtcagagaccagctgatcaacatggtgaaaccccatgtctactaaaaatacaaaaattagctgggcatggtggtgcacacctgtaatcccagctatgtaggagaattgttggagccttagagtcggaagttgcagcgagccgagatcacatcactgcattccagcctgggtgacagagcaagattctgtcttacaaaaaaacaaaagaaaaaaagaaatcctgtacccattagtaatcactccctgtttctctccatctcctggaaaccaccagcggactttctatctctatgaagttgcctcttctggacactcgaaatgaatggactcataccgcatgtgcccttcagtgtccagttcatgtcacttggctgatattctcaagattcacccacagtgcagcatatgtcagaacttcgtttgttttacggctagaatatattccgttgtatggctgtgttccattgtgtttacccactcatctgctgatggactttggggctgttttccgccttttggctactgtgactagtcctgctgtgaacattcatgagccagtttttgtttgaacacttgtcttcaattctctgggtgtatccctgggagtgggcctgctgggtcacgtgttttgtgtaacatactgaggagccaccaaaccgttttccatggtgagggacgtggccactgcactgtccatccccacagcgatgctctggggcttctgtgtcaccgcggctgcacccacgcttgttagtttctgtgttttgatcgtggtcatcttagtgggcatgaggtagcatctgacccattactgatggacctgggtccccctttcttatacctgtcagggccaggttggtcccatcttgatgcaggtggcctggaagcaaaggcccagcacctgctggcccataggacccgccacgggagctgctgccaggctctgggtgctcaaaactccgggtggggagtcccaggtgcagaggataaagctgtcccaggggctggggaagtgtgaggacagagccagtcggtgtgagtcaagaggaggacatgggtgtgagcagctgctgagcctcgggagccccgtccccggccgtaggactgcagccttgtcagtcatccggtcacggcaaggggcttcgngaggagaggggaatggggggaggtggaggaagggcagaggttctggggaagtcttgggtttgagcctcttctggcgtctgctaccagtgttgaataaaccaaaatgtgaactcatttcggttcaacatgcaggctccatcgcattacaggagacgtcagaaactgtaacgcacatggtcttctcccgtcctggaattttcatcggtgatcatgactgccacccctaccgcgcaatttcacaagtgggctcttataatcccacaacagccctctgancagaggcactgttatcaccccngctttaaaggagaggaangcggncggggcaccgtggctcacacctgtaatcgcagcacttcgggaggccaaggtgggcggatcacganggtcaggagactgagaccatcctggctaacacggtgaaaccccgtctctactaaaaatacaaaaaagttaggcaggcgtgatgggacacgcctgtagtcccagctactcgggaaactgaggcaggagaattgctggaacccgaaaggcagaggttgcagtgagccgagatcacgtcatgctctctagcctgggtgacagagcaagactctgtctcaaaaagataaataaataaataaatgagaggaagcacaggcataaggaaaggtcacaggccttccctgggatgtccatactgcaccaggagatggctcanagccagggcggtgtgaagatcaaccctgtgcagccagctggaagatgccatcacgctccggacttggaatnacaggtgcccggcgggagaggcctcctccggacaggttcctgctggacgctgaaatctgccctgggtcagccttccccgccggggtgtgggtgggagaacgcctcaggatgggacctgcgtctgaagctactgccctnggccagccccacacntggcttttaaactgacccgacggcggagggacagcaggggggatttctgagtgagcagagagctaagggtgagcctcagctcttctgttagtgtccctgaacctcagttcccctcgtcaggaaaatgctgcaacctgccctgtggggagagggacctgagtttgtgacagcctgcctccctctgagaatgtccccaggttaggctgacctccagggcaccccagcctgatcttaggccttgtggtttacactggggtgccttacacccatcgaatgcgcggggcaacagctcccagcgtttggtctctctgtttcacaagagcccaggtaactcggctgtctgcgggtgcaggcggcgctgggactttctccctaagctcctcactcagcccggggctggcaaggaggacgtccacatggccccggccggcggctcgggggcatcctggctgcaggcaccgccctgcgcctctgctctcctgccccacgtggtgccgtaggctccccactgtcctgaattaggaggggctctggaagctctgcttgtgtctagatcgttgtcctgaaatgtaagacctggttgtcctgaaacgtaagacctgtttcctatttttaaaatgggtgtcatggcgcccagcaggcttcagaccggagggtgaaggagaaagtctgcccggccccgctggccctgcgtatgtcctttcctttcttttgtccatcccacccgcgctcaccccagcaggaaacctcctgaacccctcctgtccaccctgctccagtactgatttcccacaggaaccttgttctaaccccactgcccagagcctcgggagtggacaggggtgctctccaaggtgaagcatggggcaggtgcccttcgtggcatgaagggccgcaagcagaggcctagcgggcagccactggacccttggcctcctcccccagtggcggctggggcaggttcttggggggtcctcggcatggggccagcagccaggctggggcgggcggagatccaggacctcacctctggccccgcgatctccttaagtcgtagctgcttctctgaccccagcgccagcaggagcgccccggaactgagcgactcccccgcgngcgccttgctggggcgcgcnnnccctcccgcaggtctccgagggagccaggacctcgcgccccacctgtccgcttctccaggaggccccggcgccactgctgccgggccctcggctggaagccctgtgtccgccgccgcttngatcccgggggnccctgctnnntnannnnnnntnnnnnnnnnnnnnnnnnnnnannnnnnnngngcnnncgngnngggnnnnncnnnnnnnnnnnnnnnggnnngnnnngnnnnnnnnannngnnnncngngcnnnnnncncnngnnnnnnnnngngnnngnnnnnnnnnnngnnngnnnnngngngnnnnnnnnnnngnnncnaatnccncncggcnngctnnnggcctgggcactgggggatgagagggacactggcngctnnnggtgagngnncctncncngngcccccagncngtcnggntngnccagctgngncgcgggcggagttccccgcccccccaccccggcaggcgcggaaaagcctcgcccctccccgtcgccgccgccccttccagctgccccgcgggcgggggcggcggcgccgggctggccgcggtgaatggagccgccggggccgcccggccgcgctgcccccccacggagccgggccgggagcgcctccggcggccgcggcggggtagtccaggcccctccgtcaggcttgcggtttgggaagaaaanggcgatgcctccgccaagaaaagagcgagcgcggccccctcccccctccgccgagcccgggcggcggcggcggnacatctaacgcgcgggcacccgggccgccgcggcccccgcaaataagcccagcctcggcccccgccgctcattggcgcgggccgcagccagcgcacccagaccctgcgctgccctcggacggccgggcgcggagccccagctgcggaggccgacggcacccggccccgagcgcctcgacgccgagccgcgcgcgccttctccgccaggcccggcgggcgggagcgggggcgagggagcaggagcggccagtgcccccgacacccccggcccggcacccccggcccggcatcccccgccgccgccgccgccgcctcaaggccgcccgctccccgcaggtggacgcggccatgggccgaggggtgcgcgtgctgctgctgctgagcctgctgcactgcgccgggggcagcgagggcaggaagacctggcggcgccggggtcagcagccgcctcctcccccgcggacncgaggcggcgccggcggccggacagcccgtggagagcttcccgctggacttcacggccgtggagggtaacatggacagcttcatggcgcaagtcaagagcctggcgcagtccctgtacccntgctccgcgcagcagctcaacgaggacctgcgcctgcacntcntactcaacacctcggtgacctgcaacgacggcagccccgccgggtaaggcccgcgccctgcacctccccgccccgcccgacgcgcccggtctccggctggaccttccctgcgggccgcggccgttctctccccggggagaaagggcttccgtcgggcgccccgcggtcctggccccgaggagnnnncggttcggtgactctccgcgtggggagcggagcggcgctgnannnncnnnnncnngnnnnnnncgnncactgacccctcggcctctgggcccagccgctctgctggcgtccttcggtcccggggcggggagatggcagcccgagagcgcgcctggctccagcgggaacnggcgacaccgggggncggggagagncccgctgcccacctccttgcagccccgaagtagataaaagacgtgaggtcgngggtcggggagcggcggggccgcncacgcgctcaacaggccgaggacagccggggacagcgggagacttgggcgtggggtcggggctcggcaggaaggctcccccgccgggtcggtgccgcccgcgcctcccgcgctccccgcggcgtcccgttcccccgccaagcgcgctccttcagtgcggacgcgttncacgcttcaagcgccgccgcgcgccccgggaggaccgccgcccgcgccgaggtgacagcgggacccgcgccgggcggaacgtggggattttccacggaccacagccccgcgcggcccgttccccgccccgcgagcgccacctcccgggaccgccgccgtccntgagctccccgtgggcctggccgagggcgcccccgtgcgaccgtcgcgcgcggccggaacaggtggcgcgttccctccgccggagctgggcgcgcggggcgcggcgggtcggcagccctggccgaccccccgcggtgcgtcctcccccgcagctactacctgaaggagtccaggggcagccggcggtggctcctcttcctggaaggtgcgtccagggctgaggcggggggaggccgggggtctgtgcgcgcgggcctgagcggcggtcgtgtccgcaggcggctggtactgcntcaaccgcgagaactgcgactccagatacgacaccatgcggcgcctcatgagctcccgggactggccgcgcactcgcacaggtcagcggcgggccctggggaaggcgtctcgacgtgaggcccgggaggaagccgcgcccgcctcctggagccccagccaggcccccaccccgcacatcatgcccagcctggcgcccgggtttactaagagcaaggggcgcccttcactcttgccttttggggcccattccacattagcattcaggcgcttacccagcggctctggccctccccagggtcaaagcagggcaaggggttgaagtcaaggtcagacctggtgtccagcctagccgggcaccgtggccatggtggcttcccgggggtaactaaacccaactgtcctccactttcccggcaaccttggttcgggctagcaacaccagcacacctcccttcctggggccaagtaggagccccaacacctcaccagggttncccagacccgaccctacacagcctcctcccgctagaaagacccaccgcctctgtgtccccaggcacagggatcctgtcctcacagccggaggagaacccctactggtggaacgcaaacatggtgtaagggggcacagggtcttgcctgggagtcctgcctggagggtggttcttcccggggggtccttccttgggaagtcatattctgaaatggtctttcctgggggtcctgttctggatggttcttttggggaggtcctgntcctagaggggttctggaggtgtttctttcgtggtggggaggaggtcctgtcctgggatggtccttcctggtggggaggggtctatcctgagatggtccttcctggcagggtcctctcctgggatggtccttccagggggatcctgtcctgggatggtccttctttcctggggggtcctgtcctgagttggtctttcctggaaagggtcctgtcctgggttggttcttcctgaggagtattacgctggaggtctttcttgaggggaagttctatcctgggatggtccttccaggggaatcctgtcctgggatggtcttttctgagggtcctgttctgggggtcctttctggaggctgccgggcggcaggcgctgtgacaggctcactctgttctgtgtngcagcttcatcccctactgctccagtgatgtttggagcggggcttcatccaagtctgagaagagtgagtctcggccttcccagggcatggcagggcagggacggggccggatgngcagggcagggaggaggcaggacggcagggcagggatgaggcgggacggcaggggttctggggaaaagcntgactctcagccttgtcgtgctttcaaagcccttgacagtatgtcccagggtgcctgccccatgctcccactgcctgcttgtccacaactgtaggaggtccttatttctgaatattccctggggaggaggccccagcatggcctggtgcacccgccttcctccagtccacccaagcccctgaccccttctcagaagattcctcccagtcccccagtggggcaagaacttctctgccagccattctggggtaggaggtggttctctctgtccaggcccctacctgaggccaccccctccctcttgcagacgagtacgccttcatgggcgccctcatcatccaggaggtggtgcgggagcttctgggcagagggctgagcggggccaaggtgctgctgctggccgggagcaggtgggcagggcggggcagggctggaggtgaggggtgaggacggtgtgcagggtgcatggaaggggtgtgggngntggggttgtatgagangcgaggatggagtggagcctgtgcagatcttggcaggtggctaggagggtgagaggctggagctgggagaacccgcatcattggagacgtctctgaggcctggcttcagagtgctgggtaaccagacactgtccagaggatgcttctggacgccatggttgttggatataggggaaggtttgggctgcagggacctaagtcgttggttaggggttggccatggactaatgctccttctccagggcccggtagatgaggatcacccctgtgggttcctgtatcccagcaggcatacangagnccaggagacaaatggggnatagatgatggggcctgaggccacatagtttatcttcattttcagataaggnncctganggtnaagagacananagaggaangggaggaggaaggggagagcctggctgtgtcagggaaatgtggnctgncagcctgagccctggcctgctctggaggggacggccatgggtcttgcacgtgancagagaatgcagaatgcatccgcagttcagaacgcatcaggactcctgcccccctcggggcacgggctgacgctgagcagactcgggggaggtgagtgcctcttcccagccacctggcctcacgtctggccctccttgcagcgcggggggcaccggggtgctcctgaatgtggaccgtgtnnnnnagnnncnngngnngntnngnnncccagccatccaggtgcgaggcctggctgactccggctggttnntggacaacaagcagtatcgccacacagactgcgtcgacacnatcacgtgcgcgcccacggaggccatccgccgtggcatcaggtgccgcagcggggagggcccgtcctcgtgctgcagctttgccccagaagggcctgggtggagtggcatctgtgggtggggagccccgggggacgagacccacggcagcctaacctgtggctgtggctccaggtactggaacggggtggtcccggagcgctgccgacgccagttccaggagggcgaggagtggaactgcttctttggctacaaggtctacccgaccctgcgctgtgagtgggcggcagagcggagcacacagggcagcaggggtggccacacttccttgcttctgaaaatccagcgtggactccagtcttctgggctgggcttggagaccacggccctggtccagggaggagtccggctgtgtaccagggaggaggccggctgtgtaccagggaggaggccggctgtgtaccagggaggaggccggctgtgtgccagggggcctagtcgctgcggcatgcctgggacttgcctgccctcagcactgacacccctcagtcccaggcaaagtgggacaggtggtcaccctgcctataccggtggctagtgtgctttggagctcatccccatgctgcccctccctgctgcagggtcctgggctagttcctccccagccccacgctctgaggaatggtgaggttatatgcaagggcatcatcaccatatttaggtgaaagtggagtcgctgagaaccaggccaangtcatggaggggntaaacagagcccgtctncaangaaangcagtttantgattnnnntgntnantnngnnnnnnannnannnnnnnnnnnncgtnnnnnntcctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannncncatnnnnnnnnnnngnngcnnnnnncnngnnnnnnnaggnganggcgcgncggcgggaggnnnaactgcgcatgcgcaacccgcgcgccgtcgtccctggcancactggctgctctagcgcctggcggggtctcacgggcgggcctgggcgcacggccaaagcgccaggtctccacccccagcccccggcgtcctgcagccggagcctgcctcgcctggctcctgcgcccgccgtccagggcccctgtccaagctcgcggacgccggcggcgttttccagctcgagtgctcagcctagggcaggctctgcgtgcgccccctcgagtgccggcctgggccctgccaggcagaggcgctcttgcgtcaggacggcgccgccggggccccgcgattccaactcgggggtcccggagcggcgcggggcggggacggcctggcagctcccagcagcgaggggcgatccccgcccgcgcagcagaccccgagctgcccaggcccttcctgcgccacgtgtacccagagctccgcccgggggagacttcgctgcttgttggagatgcccagcggtagggggcgaggactcgggaggaagataaacgggggatcccgtgtctggactttctcctccaccctcttcccttcgcagctgtgaatcctgggaggggaagggtggccgccccgccagcaggtgagcggggaggaaggggcggggacgggctgtggggtcctcctgggctccgtccatgaacaggccggccccaaagtcccgaagccgtgaggtgtaaggctcagaagcgtccctccgcctgtccctgccagaccccaggaactcctccgagccccacagcacgttgtcgccgtgtgcgctgtggggctgcgtgtggttcttacggtggtgtccttagtcgtcggggacctgctccccctgctctggacacagcccngagtctcacaggctctaggggcatgatatggtcctggcgtggcttccgaggcctcaaccttagtgtacaaaacagcacacggggccctgaggccaggagtgcagctccgtctcctgcctctcctccctgctcgcgtcctcatcctaccacaccacactgggctggcgaggggagggcgccctgagccgctgggcatcctgctccgcgggagggtgaagtcgtgcattgctgggcggtgagggctaggtccacacagcggggacctggcgggcccccgagtctcctcaggacccgccctnccgtgccacacagcgggagctggagccacggtgccgtcaggagccaggggtgattggnccctggggctggcagcccccnaccccgcgggcagacgctcaccaggnctgtccccactcactcccacaccccaactcctcctcacagggtcgagcccgctctcatttgcacctccgcgcgaatttggaacggatttatgaatcgtcctcactgcggtgctgtcttctcctgggaaggagcctcagtcctcccctccctgggcactgtcatagagatgggcaggacgggctggggaggacactcagggagctgcccaggctcctttgctgcccnctcaccccagaatcttcttggggtgggtggggtcccagngcacctgcagagtagcatacggtggcttgtagaaagagtatcgagggaggggaggtgccacgtggaaacagcccaagccaaacccctaggacctgtctccctgtcctcctagagagctgaaggtgttccgtggtcagtgagggctggcactggctctgcacgaagatctcctcacctccccagcggctcctggccagctccccacggagagcccaggacacttgtccctggacacagtggtgcagccatgcttgggccaaaccatgaggccaccagaaccgcgaaaggctactgtactgagagggatactgcgagagaggcccacanggtttccaagcatccctctcactccgcacactcatctccacgaccggctttaagtgcggccttgaggcctggctcccntgtttggacttctctgcacctccaggagctcacttcccgtcacagctggatgcctcctcccgcaggcacctcccgggcatcctcccgccccaggctgcaccttctgtgggactggcccccgcaggcacctcccgggcaccctcccgccnccaggctgcagcttctgtgggactgagccccgcaggcacctccccggcatcctcccgccccaggctgcaccttctgtgggactgagccccgcaggcacttccccggcatcctcccgccccaggctgcagcttctgtgggactgaccttaagaccccatcggttcctcctgagagcagcagatctcagccagatgctgnccgggagggaggtgctagcgtccnacacccagacgggtccagtccagccctgctctccctggtctccaggcagggccctcccnagggtggacattgcccatctctgcctggccaggggctgctgacccactggttccagagtctgagcctgtcctgcacaagtaccatggacaggggtcagccgggcactgaagaggcgtggcagaattgggcagggcaagggccccagctggcaagctggagtcagggcaattccaaccaagaaactgcggcaggccgggtgcagtgtctcaagcctataatcccangcactttgggaggcagtgggagaatcgcttgagcccgggagtttgagaccagcattggtaacatagagaccctatcgctacaagaaaaaaaaaaaaaaaaagctgggcatggtggtgcacacctgttgtcccagctattcaggaggctgacgtgggaggattgcttgtgcccanggggttgcaggctgcagtgagctgtgatcataccactgcactccagcctgggcgacagagaacctctctaaaaaaaaaggaaaatgaaaaataaatgggggcagaagctgagccaagcagaggcgggcagctcctcctccagggcccacctggcctgctggggactcactccaaaccgcttcatttttggagggggctttccaggactgagaggtgtcagagctgctggtgacaggagcagggaaagcaccatctggccagcccccaggggccccctgtagggttcctctgcctggcagcgtttcgacgcttcttnggcaggatccttgggtccttggcccccggcaccatctccctccnttgacctgctgaggcccacataaaacatgttgctacttnggggtngggcccgtcctcacgctctgtggcttcctgggtgtccacctccccacagcctgcctcacctacctccccagacttctcacgcacngtcaggagcctcctgtggactctggctctacctgcctctggcctctgcttaatcaggaacccacagtgggaaagctcctagggcccgcctgctgaangcaaacgcctnccttgcaaagcccgtctgcagccccccacacacctncctcacctcnctgtgcttcctctggagcccaagaccagtctgcctcacttgaaacccgcgtcgcctgctggcttcccttgtgtccccggaccagaagcacctttggcagccccgcgcccctcgtcttgctctgcgtcagcacctgagaatgggcgctagcagggaaactggctttgaggggaatggtcggggcagctttggtcctgggacaggcgtgtggcctgtgggacaatctcttctgggggcacctctgcccaggtgggaggagttgccagggtctcccagcactgccaggcgctttgctggggcagggggttattctattgctcacagccctgacacaagggcattccccacccgccctgatgcccacatccacccatacaggagggggccttcaggggagcctgcagggactcccggcccagcaccngtccatctgtgtcccccgcttagctcctgcactgccagatctcagccagacagcagggactcaccccacctaccgtcccctttgtgcctgggtgtggtgggtactcgnttttatggggagtggccaggactcttgccagggggagagtggcggtggaggatgtacccatgccatctgccctgccgcagcgtttcctccctgttcccctgcatgtcttccctccctcgggggaaacgcaggattctgttccccaagcgccctctacacgccccatatataccaagcatggttctgcagtgagcctatggggtctctggaaatgagttcccgggataagttccagaaagttgctcagctctcctaacccctgcacaccctggagccccctgcataccctgactcctggcgcacctgggacccccctgcacaccctgacaccctgctgctacccagcccagctcccctcacacagtgtgcactgcctctggagggaagggggcctcatcttgctgtctccatactcagtaactatgtgttggttgaaggaaccagagcacccctggcccttgtaacccaaccctcagcagctcctccaatcctgtgggcctcctggnaatgggtgattgtatgtgtccacttgactgggctacagggtgcctgagtgtttggtcaaacattattctgtttctggcaggggtggggnaggggttgcatgagactaacatttgaatctgtagacttttgcattagattacattgacattttaatcagtaaggcagatgccctccaagatgtgggcgggccttgtctaatcagttgaaggcctccactattccacccacagtaaccaccctcccacacaggcagggcctccctcctcatgtggcagacagaagtcaggacactgggggctggaaaccaacttataaaactgaaagggccaggacagaactgatagcaccctcccagggaggtcaggagcaggaggtggtggccacagaagttcaccagcagcccaaggagccctttccccaaatgtccatgggatctgcgtgcttggcagccaagaggggctgtggcccttcacgctggacttgggatgcctggaccctctggcccttctcacacgggaaggagaggtttctccctgaatggagggcagggaggggccgggagggggcgtgggatcccacctctgctgagccttcacagagggggtccttgacctttgctctcaggaaggagcccgtgccnagctgatactggagtaggagtgggtgaagaccctccgggctcccgagctctagaggaaggtggtcctgacatggtttgggagcagagaagaaaggaggttgaggttgngggaatccacccctgttctgggctgggaagcacttgcagaccacagagatttccagtgggaagtgatgtggcccctccctggctatgtccctggctggcccctgcgctgatcagagccacagaaagtgggccactttggggaccccctagtccccctagtgacaagagaagagaagngtggtggcaggatggtggtcaggcaggacgtgtcaatccttgcccgctggggccaggctgcgggggagcagcttggtgtnggnccagaaggtgacagagcggtccctgcaggggagtccagcttcaccttgtccaggatggtcttcttgatggcggctggtgacacctgctcctggtcagccatggactgcagctccctagagaggcangggagaggttggctttggagcacaagcgtgcacccaggaagagggagtgaagcccancagctcccagtgccagtcagccctgggcgatgctgtcaccctcacctcagcacctttattcccctctgccagcgacacgcccccacacagctgctgggctccttctcacctcattcgaatcagctcagcatcaccaaatctccccgcagtgccccccagacctgagttctcgtggccccaccacgggatgtgggtttacacctgtctcccctgcaggctggaggtgaggccaggcccctncgtgttcccctcactgttacagggtggcactcgcagagtctgagggtgtctggactggagagtgggcagtgtggcgagaaagacgtcctcacccaccctgcagacctgaactggggacagcggctcccagcctggctctgcctttgaccagctgtgggatcccaggcaaacagcaaactctgtctttctcttgctctttgcttctttcaccttccatgngaattttccttngtgcctggatgttgctgcgtgtcctacntggtctaacttaatcccacagcgagggcaggaggaaggtgggcccccacagaagtttcctaatgtggctggccaccccgccaccccactggtgtggcccctggctcaaatgacactcctagctatgacaatggtgaacctatgtggggagcacagggcacagcatccgggtccctctatggatgttccctcctcgcaggaaacggaaggtggggaggggcactgcccacagtaacccagggaacctcggggcccccntgtgtcctgcgcaacactgggctggagctcaatacgtatctgctgagtgcgtgaatgagcagatgtgtgtgagagaggcctctgccatgcaaggactggagaccagggaagcgggcagcgcgggggcccanccgtgtgcggatgcaggaggcctccacagcgttgatgagcagggagcggaagcccccactnctccagcacatgcaaggcatggatggtggccccaccaggagagctgacgttgtccttgagctggcctgggtgctgttctgagtgcagcagcatcttggcagccccctgcagccagaagaaaggctgacggctgtgggcacgcacctgcctctgcggggcactgccccagccactgtagcacacactgacgccccacttggctcctcccagtgaagccccagggccccgcaaagagtggccccaccagagggtcaggaaacacactgaccaggagggcctgggccccgaggcggactgccaggcgccttggaagtcccatcttcacacccccatcagccagggcatccagggctgtgaatgcctgtggggagaaggcaccctgagcctctctcctgggcttctcctccttcccttctgggcaagctccagttcccacagccttggagccctccaccctggccctcccagggggagcagggacagatgtgcccggtggtcccgggaagtgcccgccgccgccagcttcccccgcagtccttacgtaggcggggccgctgccactgagccccgtgacggcatcaatcagngtcctcttccacctccgtgcagaagcccacgctgctcagcagctgctccatgagcctcccgtcctccacctgggcgtgcgtgcctgtggcatacacnggtggccccctcccgcaccacgactggagtgttggtcatgcagcggatgaccctggggngctggccgaaacgctgacagcttctggaagagaaaccagcgtgtccgtctggccatggacgcagtgcctagatgcactcanccccaccaagcagtgcccgagctctcccagtgggccgggacgctgcaacccttttgcagatgaaaactgaagtactgagggcccgggctctagacagcccctctccacaccccactgggcctgcggtgctaccttnctcaatggagctgatggtgacgccggccgcgcaggacaccacaatgtgtctgtccntcaatgtcggcgcctatttcatccaggatgaaggggatgatgtgtggcttcacagccaggaagagcacatcactgtgctgcaccgtctccttgttgtggggtgtcaacttcacccccatcttctgcaggggcaacaggtgggctcagcctggtcccgtggctgtctgtacccccaccaagccaagagccccacaggtagaatggcacagagaatgctggnangttngggggtgggncagggnctgggggctcagggctctgaccaccccncnttngatgacccttcccacccagaaatggaggaagaactctgtgtggaatatgtccctgctgcagacagaaaaggaccctccatccatgccaccaatctgcccccagcctgggactgccgtcctccagaccgggctctccacgtgggagtggtggtctcaagcagcccccaggtgtgttccttggctgccaggctgtggccccacctgccaggcccccagaggacccctcgaaactttaaccctgtgcagggaactccattccagaacaacaccctcctatcagctgtacacacgcccaccacccaggtcccaagagcaatcagcagggcgaggaggtggggtccatgagaccccagcccagggcccctgnccctcactggggtgggggctacagcacacactcctgcctctcacacccagccccacagggactcagtctcctttctccctttcatctgcacctaccctgagagcagnaaactgtggccaggtccatgtctggggagctagccattatcttgtgggcagccaagacgcctgaggggagaaacagttcctcttcagttctttattatttttttttttttgagacggagntnctcngnctgtgttgcccnaggctggagtgcagtggcgcaatctcggctcactgcaagctccacctcccgggttcacgccatgctcctgcctcagcctcccgagtagctgggactacaggcgcccgccaccacacccggctaatttttggtatttttagtagnagacggggtttcactgtgttagccaggatggtctcgatctcctgacctcgtgatccgcccgcctcggcctcccaaagtgctgggattacaggcgtgagccaccgcgcccggccggaaacagttcctcttcatggctagctttggcttccctccctccccattcccaggaagaagagtgagacagcacaggtaaagccccaaacacacagaagttgccagttcccgcaggactcaggccttgtgacccagcacccaccttcagcccccagccctgcagaagtggaaagaggccagtctctcccactgggcctcaccgtcccccacctgggggcctacctgctgctgtgaagcccttggccagggcaaaagccagctggccagcgccgatgaagcccacgctcatgctgtccggagacccctggcccaaagcccccacagatggcaccggcnntgcgggacgagaccggcaggatcgagagcaagttaggggggcagtgccagcctggccgctcctcccgcagccgggtgcccacctcccctggtcccagctggtctaactttccactttgctgtccggcccgttaactgcttcggggcccccagtcagagcggcggtgcctggcctgctgcctagggntcccgcacccactggaggggtggaggttccgcagaagaaatgactgggaagggggaaaagtacggggagagggagggcccggcgcctaggggtcccccgtctgggttcccaccccgcccagaactgggctaccgtcgcgccccacccggcgaccgcncgcccaccattcccggagcccgaccccaacccagctaccgtgcgcgggtcgtacccacccctcagcgctgcggccgccacgcggcacccgcacccaggccccgcccccgtcgcgccagcgaatccgggcgcggccgccaggcgctggccaatcagagcgcgcggcggcgccagagcggttgcatcatntgcgcgcccctcccacgccgaccgccggccctcgcctctctcgcgccccgggatcccccggcccccggatagacaccctctccggcacgcggtcccctgacccgcgctcctcctggtcgcgcttcccgggacctacacgtggggtccgaggacgcgggcggagggggcggcccgattggggcctgtgaggggccctccacgcagggctttgtcttgggccacccggacacggacgcgtccagctggcgtccctgggcgcgcggccggctctctctgggaatcagtcccttctactgtcatcgagtttggagaagcccggctgtacagcgttttctttcctttttttttttcccnttgggggcagagttgaaaataatttgccaagtggaagcattttaaatatatcaccatttgggccgggcgcggtggctcacgcctgtaatcccagcactttgggaggcncgaggcgggcggatcacctgaggtcaggagttcgagaccagcctgaccaacatggtgaaacccccgtctctactaaaaatacaaaaaattaaccgggncgtggtgacaggtgcctgtaattccagctactcgagaagctgaggcaggagaatcgcttganaccctggaggtggaggttgcagtgagccgggattgcgccactgcactccagcctgggcaacaagagncgagactccnatctgaaaaaaagagagagagaaagaaaggaagaaaagaagaaaagaaaagaaagaggcatgacagtgcggccacaggtgttcctctaactgggcacgcagcggtgctccactaagcaaacgaaggaagcccaccccatcatgcccccactcccacgcagcccggagcatcctccaatacccaaacctctcgcctgcctgggttttagggggagtgaagctccagtcacttcccccntgaggacatgctcagagttcatctgattcgggcctgcatctggggctctggatagtcagggtccctgtcggtggccaagattaagggcgaagtcagaagggatcanctggcagcccattcccnctgccaaggggtgagaggagctgccttattttttctgtgctgtatcttagatgatgacaggctattctagcacatcatttcagaaggcctgggatgcttctgccacagcggcagggccacgcgttctggctatctgtctacctggtccccccaccgtgaacacgtaatgaccaccaccaacactgggaggctgctctgtggtggccatgggaagagcttgtccagatggacagctcaaacctggggcacggaggctagcatcgcctaggcgctttgagagccaagctccccaggctgttacaaaatcacttttccccaagtgataacagcaagtaacacttttacctaaaaacccaaaaacccaaaatggacagccctctgggccagggatacactgtcaaaaggactgactctgaaggaagtctcccagccctgggtcccctccccttcctttctgtccctcaggacctttgcgaaggtggcagaggaccaccggacagggaggaaattgggaagttggtgacaattaactcgtttcagaattctggccacatgaaaaaaaggagagaaggaggctgggtcctctccaagactggtgcccaggtctcccctgagtcaggaagcaggtgatccctatgccccctctgtatcgccctcagccagcnggcaggccctgaacagctgactgccctcatctgggatctgccattgaccccaaaacacccaccccctctgagtaaaggatgtcggnccggaccctgtttgttggctaacgtgagcgagacccctcctcagcggccagtgaggccccttcctcacatntcttcatggcagcagcacaggcctggctgtggggaccgccgtctaaaaggagcaacagtgcgtctgtccatcgctgtgtccagggcctctcgagacccccanatgggcgtgggggangaggtgagtgctgcgggcctctgggagggacgggcatgagccacaggcccgtcggagccaggctggcctgtcacccctgtgaggcagaagacgctgcctgccccttccccaggaggctgctcagaccctcaggagcccagcctgccctgactgtgatcccaggccacttccttcctcagccttcccccagagcacgctaggaggggccgccaggaggggcaagtgcccacagtcccctcagaagagactgctggtccagaggcagggtacgtataaatgtcagcatttatttcctgctcaaggacgtcaatggggcccagtcaatgggctgaggggctgttgtgccactgcccacccggcttggactcaggggtggccagtgggtcagctcctggctggaccaggctgggcttctgtgcaggagaagctggctggagcctggaggatgatggccccggcgtcaggagtttcggcaactggacccttgagcagaggcaagcagtacccagattctgtgtccagcggnccgccctcagccgggctccctcccagtgccacagatgcccacagtgcacagatgcccgccgggcactgctgaagctgcttcgtcacagccaatggtgagtgtccaggtggggctccgtggctatggcggaaccaggtcctccccgtccactgtgcactcggtgccgccgggctctgcaggctcttccaggccacccgcgccacctccagcctgcggagactccggaggaagcctgcttccaaacactgtggctaccagcccagaggcttcccggacgtgggtgggagaggctggtccagatttctggctccttctctgtgagctggcacagctccccaggcagggctctcttcccagggttctgggagctgcctctctgaaccaggagtggttccggctccccacgcccctccctccccttgcctggcccagctactctcctgggttcgtctcctctggaagtcattcctctttcagcttgccttacccagcctgactgtggtctccagacactaatggaggtactgggtgcctcgcaaatgcttctagcctccatgtccccagctgcaaaatgggtcacaacagcagctgctttaaagttttcccttatgatgttccagtgaccagcactgagcncccaggagcgctgggaaatggtgagagagagtgagttggggattggcctaggtgaggnctctcccctgcgtctgctcagggcctctgccctactgtcctgcccttgtccctctgagcccagtctggaagtcggggagtgacctctcccgttgtacttcatctcccctgagcccgcggcttccctcctgctcgctacttgacactttggttcacctgagtttccctcgcagagcctggagctggtggccagagagcagaggtgggtgggctgccactgtgggctacaggctgggcacgaagcgaatccntctgggagtaggcgaggtcaacgacgtacaggagcaggttgacgtaggtgaagatggccaccaccagctggctgtcccagggacagctgccccgagcacagttggggggccgtttgggctcaccgtacttgggatcgaaacanaagactggccagatcacggcggcgctgaggtacaggagcacagccaggaaggtgtacaccaccaccagccggtcaaaggggcagcccangccccnctgtgtggcccatcacactcagggccaccacggccactgtggccaggaagcacaggctgtagacggccacgcaccactgggtggccacgtagcgcccgtagcggctgtcatggaccagcgccccgaagatgatgcaggccacgaaggcctggacgatcttganggagccccgacaccgtggccatatagctgctcacctggccgggccgggcccgcgtcagggccacctccacagcgtaggccaggaagaggagcccggcgaagacactggctgccaggcggaagtccctggcagcacagccggcgggctcgggggaacactcccgccgnggcaaagtacagcggatacaggaccgcagccgtcgcgcatagcagggtggccagcatggcgaaggcggcggtgaagttgccccaggagagccgcaggcagccgtggagccgtgtgaactcacaggccaccaccagcgcagagacggcgaagcagaagccccaggcggccatgcagaaggtgccctggacgcccgcaaagccaccccggtgggccaccaggctgaaggtagtgcagccaaaggccagctgcagcacgcgggctgtgcccacaggggatgtcacggcgcccaggtgcaggtacgcacccccagggggctccatggtgctgcccatctggccagccacgtttccagctcacacagtcccccaaggccctggggntccctgctgggccaaggcccctcagtcctctgcggtagtggcaggtgcctgcagcctgcagaggcagtgacgacggtgacattgcagcagggcagcctctctgctgtctatgtgaggcggctccccccagcgctataaatagacagccgtgatcagagccccggaatagcagcttgcgtgcctgtccccatcttagagagacatctgacccctggtcccctgtggagcccctgccgggaccattaacccattggctgctggcaccacccccnacctccgcctcccgcgcacctgcatctgtcaatccggtcagttggtttcacgcttgtgggggagggggagggagaaggaggggagcaaagagcatgagggtccccacggggtaaccccagctccagcagcctccagggccagctgtgcgggggaggggtgtaggaggcaggaggcggcagcctgggctcctggggctcgcgggggtcggggatnggtttnccccaacatttatctcaccccttctggatggccgcgtggttcagagcctgcatgggcttcaggatcctgctgtcattgcctggggttcacagggttctgctgcggccagaggagcagagcatggagaccgtggcctctgctccccgagccccgctccccaccctcattctgtctcgtccctaacctgcctggggcagagacatttgactgttagttactgttactgtttgcaggggccattctggggcttttcacttngtccttcacattaaacacctagaaaaacactcaactcttccctttttttttgagatggagcctcgctctgtcacccaggctggagtgcaatggcgcgatctcggctcccaggttcaagcaattatcctgcctcagcctcccaagtagctgagattacaggncgtgagccaccatgcctggctaatttttttgtatttttaatagagaccgggtttcaccatgtntggccaggnctggtcttgatctcttgacctcatgatccgcctgcctcggcctcccaaagtgctgggattataggcgtgagccactaggtccggcccctcttttttttcgagatagggtctagctttgtcgctcaggttggaatgcagtggtgagatcacagctcactgcagcctcgacctcccaggctcaagntgatcctcctgcctcagcctttttatttatttacttatttatttatttnaaccacttgcactcacttccacctcttccatttttaagctaaaatatgaaatgtttttaaaaaggaaaaaaatgatatctttttttttttttgagacggagtcttgctgtgttgctcaggctggagtacagtggcgtgatctctgctcactgcaagctccgcctcccaggttcacgccattctcctgcctcaacctcccgagtacctgggactacaggcacctgccaccacgcccggctaatttttaggatttttagtagaaacgngnangttttaccatgttagccaggatggtctcgatatcctgacctcgtgatccacctgcctcggcctcccaaagtgctgggattacaggcantgagccactgtgcccggccggaaaaaatgatttcttactaatttttttttctttttttctttttttttttttgagacagagtctcgctctgttgcccaggttggagtgcaatggcgcaatctcggctcactgcaagctctgcctcccaggttcacgccattctcctgcctcagcctcttgagtagcntgggactacaggtgcccgccaccacgcctggctaattttttgtatttttagtagacacggnggtttcaccatgttagccaggantggtctcgatctcctgacctcgtgatccgcccgcctcagcctcccaaagtgctgggattacaggcgttagncacctcgcccagctttgttactaaanagagaaagaaaaattgcctgtaattccatcnccnggatnnaaccactntgaacatctnnnnnnannncnnngnnnnnnnttcctgcactttttgcttataaaaacttcaatccatttcgggagtggaggttcctacctgggatcacgagcattttgggacaggctgatgtacagggataatcacgtgaggacatggacactgttctggctctgatgcagggcatccgatgggtcttgaggacgtaaacatggaccttcatcccgtgtcatcctctctggacccccaggagtccaagagaaggggcatcattagtccgattgacagtggcagcaacctcaccacagaacctcatctgtccagcttgatcatcaccaacaggtgcacttgggtggaggcacctcggaaccgcctcatgggcgctctacgctagacttatcgtgccctccccctcggagacgcctcatgagagctctctgctagacttaccctgccctcacaagttggagtatgaagcgcaaaaccagtagaatgtaaccaaggagctggccttcctggaggctgccaggcagcaagctttacagcccctgggggagcgcgatggtgacttctaaccaggcagaagccctgcgcgacctcacctgctttgttcttggcctctgcgtttggactaggaattgcaggacttcctctctactggcctgctctggaaggctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcagcgcgccgagtctgcgtatggccggggtacgaggcgctccctgcgcagggtgggcaggaccgaagctcgccgggagnctgncgcggangggcgggcggggaccctcggctgccgctcccacccccgcggggccgcncccgagcccgncctccgncgccgccctcgccctgcgtcnccgccggaaagtttgcaccgancccgatctggcagcgccgngaagacgagcggtcaccggngccngacccgagcgcgcccagaggacggcggggagccaagccgacccccgagcagcgccgcgcggtgagcacctgggccgcggccccgaggggacgttggggagtcgacccggtggggacagagaccgcggggcgggcgcggcgnggccgngggcgcggggagcggggagccggccgggcggtctccggggtccgggctggtgcgctcctcagtcccgtcagacacccccgttcccaaccccggctcggacaccacccggtcctgcaccgtcgggcaggtccaggggtctcagcccctcccccgttctctggtcctggggggcgcggctgggggcgggggtgtcgctggccgcctggcgccctgcggcggccacactgcagcggccacactccccactcagggccccgggccccgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcctcttccgcggcccacactggcgactttgaccccggcaagcgggtcactgccctgcccggctccggcccccccggcgccccaccacccggccgactcggccaccgggcttatgctccgactctgaaccgactgaccccggccccctcggcgcccgcatcctccaaggaccggccagggctgctctctgcccttggtattggggacatcagggttggggggtctgggtgcacccacgcctgccccgcccccacggggtgagggcgcagggatagggctttgtcaacagcctgtggcccctgatcccgccccggtgccctgaccttccactaccttctctggtttcacaaaaacatcccnggctcccatcccggagctcctcaaagcgtctgagaggccccttgcggacgccctgggagccccgctgccttcctggnaccagtggccgctccacccatcctgggggcccagctccaggtctgcgggtccctcagccgcccccagtgggaatcggtggagcctgacgcagccaggagcgcccaagagtcacgtgttctgccagggaggacatgggacaggacacggggtgccagccctgcaaagcggccggggcagtggagctcaggtggccctaagccctggtggtggctggtgtggcccggcaggcagctgtgggagggaggaagggggtggcatgcggtgggggtctagagaaggcgggcagggcacctcgggagcccccccattgggcacctcgggaaccccccacattgggcacctcgggaaccctcccattgggcacctcgggaaccccccacattgggcacctcgggaacccccgcattgggcacctcgggaaccctcccattgggcacctcgggaacccccntattgggcacctcgggaacccccacattgggcacctcgggaaccccccctattgggcaccttgggaacccctcccctaattctcagctgactccaaggcctgagaaggagcttggtcacctggactgtgaaggtggagggtggggtccctggtgggtcgtcccacctaccagctgtgtcgccggaagggtaatacggagcactgtggccccggggagccccgagtggcagctccacagctgggagtttctgtccactccttcagtcaacaaacattgatcctgggctgaccggggcccgggggtgtcagtgtctcctctcgggggagagggctgggtgagatcaacagaggagcctcccttcttcccttcaggctggtgtcaccttcagtgatggggcagggtccccacttgggaagttaaatcgtcgtccccgtcccaggaccacagcagcctcagncctnctctncaggccaggctctctcatgggtgctcagctggaaattggtccccccccggctccacccacccctgttggggtgaggagctggagtctcncctacccatatgggacccaccacccgcagggaacggaggacgctcacacttctgcacctcctgcctcactatcagagacccagtggagaattgcctccncacctcacctcttgtattcagaggccctgacccctnagggatccnggactaggggtgccctatggggagcccacctgtggcctgtggatgctgagctgtcgggggaatcctccaggatccccagcccnacnttnccaaccttctgttgaggctgaggggacacagagcccncactcctgggtcctgactgtttcaaagaaaggcctgggggactgggcagccaacccctccctcggctcgctggggtctccagactggctgcccggctggaaggtggggccctggcacgcgaggacctcatgtgtggaggcactggcttggggggtgctcccagtggctctagagtcaacatgacaggcatcgaatggctcctgtttctctgncagagttggggcagagccaggcttggccacgctgggctctaangggctgtcattttgcccagggagctcctggnctgggtggtcctccccccagggtgagcacgcgtcccccccacccccacttcgaggcgcccaggcagggaacagctcattggccagtgtccttcctccttgtcccccgcctgcatctccaccatccaccctgctccagctgccccttgtccctctccccgtcccctgcccagagccccaggtctcccctgcacccctgagcctgcccacctagcagtgcccctcgtccagggcccctctgggttgggggtgcacacagtnggggagaggcggctcctgctgctcctcacccagcccggctcagtggccggagccgcccaggacagtggcagtagatggggctgtttgatcaggatcagggaagataaggccccttgcgtgaccccagagctggggacgccaaaactgcccctcctcccccacccgcctgccgctgtctccgccagggagaggcccctactctgtgggtccttcgccccagcaccaagcctgcatggctgctcacctggctcaggaactggggatcagcgacacacgggtccntgcctcccatcggcccctacatgagcccagggtccaagggctgcggttgggagctctttagcagtctgtgacgcaggtgcctgtccctgtcattcagctgtcacactgncttggggcatctcaggccccgttagcggggcagccctgggtggagctggccccacngcgggctcacccagccgctacctggaggaggctaaaatccaggctgtcccgtggcagccagcagtccaggcctgcccggaaaccctctgctccagctgcagccttcgncccatctccttgcccctctccccggcttccccctggcactgccttccagctggctggccctccatctgcccagccatccatccacacctcttattccatttgagggtgccccaaagaagagcccgtaacagcccgggggctcatagccagccactcgcgggaccccgcacatgcacgtggacccacaggaagaccctccctgncttctcccnacagaanttcagttggtgcagaaactgggctctgtagcaacgaaaggccgatttgtgtagctgttgccaccccgaactcccagctcagatgctggctgtggcatggggaccaggggnctgtgactcccacagccctggcaggcaccacgggnggnatgtcctccccaccctgtgcccccaccnctaggccagctcctcctccaagtcgacgcccgcagtgctaacctcaaaggactgtgcagccagcctgtggcgtcccatgggatccaggaagcccaaccgagccttgcacggcacccacgaggcacctaggcaccccggtgctgggcagggggcacacatgtgacacagacccctgagtgtgggccccacacacttggcctnggcacagctgcaagccagcccagccactttgctcgctgtggcactggggccaagtgatggaaggtccaggcaccgccaccctcacgcttggcacattnggctcaggtcagcctggcaagccagctttcccaggggctaagaataggtgaggaggatggtgaggaagcagccgggggctgtcaactgagggaggaggtcaccatctggggaggctggtcccccacccaagagcattgggtcaccctgcaggaaggtggctgccanccagcaatgagacgaggggctctgcgaccctcagagctgccagccagccagccctgggtggcaagagtgactcctcctggggtctcctccctcctatcgccctctttttttttttttttttttttgagacggagtctcgctctgtcacccaggctggactgcaatggcttgatctcngctcactgcaagctctgcctcccgggttcacgccattctcctgccntcaagctcccgagtagctgggactacagacgcccgccaccancgcctggctaattttttgtatttttagtagagacggggtttcactgtgttagccaggatggtctcgatctccagacctcgtgatccacccccctcggcctcccaaagttctgggattacaggcgtgagccgccgcgcccggcccccagctccctctttatccctaggaccctgaggctcagaggggcagcttcaggggaggacaccccactggccaggacgccccaggctctgctgctctgccactcagctgccctcggaggagcgtacacacccaccaggactgcattgccccagctgtgcagcccctgccagatgtgggaggcagctagctgcccagaggcatgcccccctgccagccacagcgacccctgctgctgttgctgctgctgctggcctgccaggtgaggactcacagcaccctcagcacccaggggccntcctgtgaggactgcacactgatggctctctgtctgcctgcctgcctgcctgcctgcctgcctgtctgtctgtctgcccgtctgcctgcccatctgcctgtctgtctgcctgtccgtctgtctgtccatctgtccatctgcctatccatctgcctgcctgtctgcctgtccgtctgcctgtctgtctgcctgtccatctgtccatctgcctatccatctgcctgcctgtctgtcggcctgcctgcctgcctgtctgtctgctgcctgtctgtccgtctgcctgtctgcctgtccgtctgcctgcctgtccgtctgcctgtccgtctgcctgcctgcctgtctgtctgcctgcctgtctgcctgcctgtccgtctgcctgtccgtctgcctgcctgtctgcctgcctgtctgcctgtctgcccgtctgcctgtctgtctgcctgtccgtctgcctgtctgtccgtctgtccatctgcctatccatctgcctgcctatctgtctgtccgtctgcctgcctgtctgtctgcctgtctgcctgtctgtctgcctgtctgtccatctgcctatccatctacctgcctgcctgtctgcctgtctgtctgcctgtctgtctgcctgcctgtctgtctgtctgtctggttgcttgntgcatgtgtcccccagccacaggtcccctccgctcaggtgatggacttcctgtttgagaagtggaagctctacggtgaccagtgtcaccacaacctgagcctgctgccccctcccacgggtgagccccccacccagagcctttcagcctgtgcctggcctcagcacttcctgagttctcttncatgggaaggttcctgggtgcttatgcagcctttgaggaccccgccaaggggccctgtcattcctcaggcccccaccaccgtgggcaggtgaggtaacgaggtaactgagccacagagctggggacttgcctcaggccgcagagccaggaaataacagaacggtggcattgccccagaaccggctgctgctgctgcccccaggcccagatgggtaataccacctacagccccgtggagttttcagtgggcagacagtgccagggcgtggaagctgggacccaggggcctgggagggctcgggtggagagtgtatatcatggcctggacacttggggtgcagggagaggatagggctggaggactcacccgggaggcagtgcctgggttcggatgagggaggcagccaccanctgggcagaggggggcaggtgtggcagcctccattggngcagagggagcagnatgtggcagccacaggtttggcgatgcacctgggaanggatgaaaatggcattngggttcagcccccagagagggaggtgctgagagaaggtcacngagaatggggnanccnnntgnnnnnnnnnnnnannntnnnnnnnnggggtctnccaagggaaggtgtcctncagagntgnanttcagggctggnctgggcgtgctagcggagnctngtccagnggaggnggatnntcaggtgaggaaggtggaggtcagatgggngaggtggaggtcaagtgggggagggagcagcccaggccatgtcctgggcgaggtgacggccgagctcaggcttccagagagaggagagaggcnnncnnannnannncnnnnnnnnnnnntnccctgccctgctctgccctgccctaccntaccctgcagagctggtgtgnaacagaacnttcgacaagtattcctgctggccggacacccccgccaataccacggccaacatctcctgcccctggtacctgccttggcaccacaaaggtacccatagaggggaggaactgtggggggggcgggcccagggtggggctgacncccangcctcccccncnacnacncncccagtgcaacaccgcnttcgtgttcaagagatgcgggcccgacggtcagtgggtgcgtggaccccgggggcagccttggcgtgatgcctcccagtgccagatggatggcgaggagattgaggtccaggtcagtgggcggcaggcaggcgcggtggggctggatgggaacgggcatgggggcccctgcctggccctcacaggccactgtaactcgcagaaggaggtggccaagatgtacagcagcttccaggtgatgtacacagtgggctacagcctgtccctgggggccctgctcctcgccttggccatcctggggggcctcaggtaggattccgccagcgcccggggcggccgcagaggacagggaggaggacgggcgctgactggctgtgcccacagcaagctgcactgcacccgcaatgccatccacgcgaatctgtttgcgtccnttcgtgctgaaagccagctccgtgctggtcattgatgggctgctcaggacccgctacagccagaaaattggcgacgacctcagtgtcagcacctggctcagtgatggagtgagcccccctcggcggccccaggcaggtgggtgnggtgggcagccaggcaggtggccangtagccgcgctcacactgcacctgtaccaggcggtggctggctgccgtgtggccgcggtgttcatgcaatatggcatcgtggccaactactgctggctgctggtggagggcctgtacctgcacaacntgctgggcctggccaccctccccgagaggagcttcttcagcctctacctgggcatcggctggggtgagtgggctggcatgagagggggttaaggcaggctgaccaagcctttgggaccancagctgctgccccccacaggtgcccccatgctgttcgtcgtcccctgggcagtggtcaagtgtctgttcgagaacgtccagtgagtatgagcggctggacagcctggggagggaccggggggctggggtgcggcgctctggcctgaggcagggaggggccggggatgagcctggtgcctggggagggggtcatttgtgaccttctcccttccttttctgagaccncgaattagatcctggcaaaatcgggacgggggtgctgaggggcggagggngctgggggctgtgccccnagtatgtgagtggcctggcctcgncangntgctggaccagcaatgacaacatgggcttctggtggatcctgcggttccccgtcttcctggccatcctggtgaggaaatgaagagccaggaacgcaccccaggcccctcctcccttggcgtcctgaggctgccccaggagacagcagcatcctgtctgagagcgctgggagggagccggcacccagacaggacaccaggacactggccagcaccctggacactgagccaggctgttcctccctggctgtgtgcccaccagccccagggctatgtggcccagggcctatcttgctgccaggcccacctgcaggagggtcaggtggggccttccaagggcacagagctgttccctggggctcgggatgcccctgactcgcaccctntctcacacagatcaacttcttcatcttcgtccgcatcgttcagctgctcgtggccaagctgcgggcacggcagatgcaccacacagactacaagttccggtgggtgccgcggcagctggcgtctcgagacctggagaccctcagggccagagggcagctgggggtggggactccaagctccacgtggatggtgcgggccgagggtgggggcggtgggtgactcaggcgctgcctctgcaggctggccaagtccacgctgaccctcatccctctgctgggcgtccacgaagtggtcttcgccttcgtgacggacgagcacgcccagggcaccctgcgcntccgccaagctcttcttcgacctcttcctcagctccttccaggtgnccgcncgcccgccggctcccccgcccggggcgcagtgtgccacccctgaccaccctgtctctccagggcctgctggtggctgtcctctactgcttcctcaacaaggaggtaggtgggagtgggggcatctgagaccatcagcactggccgtcggggtcaggggcagagagaggcacagggatgccagccccacccctgcccgggggttggaacacgtggggcccaagcctttccctccccctgctcttattgggtgcagttgccatggcgctgggtgtcaggcccccaggacaggttggcctcagccccatcgctacggtgtccaccgtngggggtccccaggtgtctgcagactgctttccgtggcgatgctgggtggcatagctgtgcccagcagggagcttgtgtcgctctgcacccctcagagcggagactgggcatctccgatgaggcccacagcaggtcccggntggggtggangnanggacagngcaggccctaggactggcctgccccgtccccctccccaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagnagggcgtcgctggacaacccagaactggacgcccagctgaggctgggggcgggggagccaacagcagcnccccacctanccccccnacccccagtgtggctgtctgcgagattgggcctcctctccctgcacctgcnttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaangtggtcacncgtgcatgtcntggaaagcagggctgganaatgctggggccgaagcnagtgggggatggaacagncggtgggtggtcagcgccagtgcgggctgttgaagggtccccntgctgtcccagttcactcagagttggcactggaaccccggaggatccngaaggcagccagcctgtgcccatctgagcaggtcctggccaccttcccatcntggttctggcgggcagtccccctggacgctttggccaccagagggtcaccattcaccagcagagacntgaggggcacagtggctaaggcggcatgaggcatcacagtcccctgaccgaccccatcagcactggattcacccgagggcgtcttctccctggaggccgtgaggacactggcacctggctcatcggcccgcccttcctctgagcctcctggcctccgtttcatctcagctccagccccctcgggcaatttacaggccacgtagcagattgaagcgggaagaaatgggcctgaacanttgccgcgggtccaggcgacggaggagggcaggttgcccaacttctgcacaggacccggggtgcgccacacacacgccagtcctcgtgccacacagagaggtccggcctacgccagtcctcgtgccacacagagaggtccggcctacgccagtcctcgtgccacacagangaggtccggcctacgccagtcctcgtgccacacagnangaggtccggcctacgccagtcctcgtgccacacagagaggtccggcctacgccagtcctcgtgccacacagagaggtccggcctacgccagtcctcttgccacctcgtggtgggtgggcgccctgcttgccagccagggagcaccaggaaagagctgcctcctgcgtgctggacacaggaggtgcttcagggtggggtctcccattgtgtggggcccaacctgagtctaagggcccagggaccacacagcgggggtggagacaaattcagggtagaagctgtgaggggcctgtggtcagccccccggggggtccctgcagcaggcactgtgagacctactgaggtgtgtgcatgggctggggaaggagccagtcaggtgcccctgctctgaggagctgctgggaagtgctgctgggccctgggnggaaggggtgctcacagcccctgcctgggccacgtgggctggangccgctcaggcagagccggactaattggggcaaatganggggacaggaggcctctgaggaaaggtaaatagaattactcacccgccaggcactggggccctcctgggggggccctcanccctgccacccaccacagggcctgcatgcagcagggagggaagtgagctgattaggcaaggctggacccttctggggccctggggttgctgtgattgggancggcaaggccaggagacggtcccctgagctgcacctgctggaggcctgtgatctcagaccttaaggcttcaggccagctctacgcccctccggcctcaggtcctggctctcctctgagccctggatgcccngggtgcctgtgtgggcacgaggctgctccgagtcagcacacggaggtggacattctccttcatgccagctgagctcagggctggtgactgccctggggaaactgcccctcacctgggacctcctgacagccctccccattcccgagtccctctgcccttgtcctctttcacctctgtcccgccctcatccctaagggaactggagcaggctggtggagttgggtggagttggggactggcagggggtggactcacccaggcaataaacactggccctaaccaggcagtcctgcaggcaggtaggtggagggactgttttttttcttttttggagatagagtctcactctgttgcccaagttggagtgcagtggcatgatcttggctcactgcaaactccacctcccaggttcatgtgatntctctgcctcagcctcccgagtagctgggattataggcgtgtgccacgacacctggctaatttttttttttttttttttgagacggagtttcactctcgttgcccaggctggagctcaatggcgcgatctcagctcaccgcaacctccgcctcccaggttcaagcgattctcctgccttagcctccntagtagctgggattacaggcaggtatgtgatgcccggcatcccaaaggggtatctgcaagagttgggtgctgtgtgtgcatggctgggaggaagatgactttgataccctggaatncntggtgtctgtggacacaaaaatactantaaaatgagagtggagaccaggaaaaanggaagacatgannctacatgaaggaccaaatctaggagagtcagaagtgcgtcacaggaataggggaccttgagccagacagaaggctcagcagagacaccctcaaggggatgaaagggattgagtgcactaatatttagaggagagagttcaggacttgattagtgactagtacatagaaaactaaacaaatgaggctgggtgcagtggctcatgcctgtaatcccagcactttggggggccaaggcgggcgaatcacctgaggtcaggagttcgagaccagcctggccaacatggtgaaacctcgtctctactgaaaatacaaaaattagccgggcgtggtggcgggcgcctgtagtcccagctacttgggagcctgaggcaggagaatcgcttgaacctgggaggcggaggctgctgtgagccaagatggtgccattgcactccaccctgggtgacagagcaagactccgtctcaaaaaaaaaaaaaaagaaagaaaaaaccaagcaaatgaaaaaagaaggcaattaataattccaaagaaaagaaaaatttgggcagaaaagaacaaaacaagcagaatttaccatgactcagttctgaatacaaacacagacatcataatgtaaacaccaacactgatgcaaccagaatcatgggagaaaaanagatctagggagggtggtggacgggaatatcacgtatgtactgggggtaggggagagaacaaaatgggaaaaatcaagaataattcacgttagaaataaaaatacagagcaaaatttaaaaatgcaaagaatgaggtgaagagttcaaagtggtcanccntcggggccngggcgcggtggctcacgcctgtgatccnagcactctgggaggctgaggcgggcggatcacaaggccaggagtttgagaccatcctggctaacaaggagaaaccccatctctactaaaaattagccaggcgtggtggtgggcgccngtagtcccagctactcgggaggctgaggcaggagaatggcgtgaacccaggaggcgcagcttgcagtgagccgagatcgcgccactgcactccagcttgggcaacagagtgagactccgcctcaaacaaaacaaaacaaaacaaaaaaacaaagtggtcatctctaggcaaggtgggtgggagatggctagggctgcaggtccactacgtgagctggctcagcctatccccagacaccctgcactcactcagcccggggtcctccccctgcactcactcagccccgggtcctcccctgcactcactcagccccgggtcctccccctgcactcactcagccccgggtcctcccctgcctgctctttctctgaccctgccctccactgttcctttttcttctttctctnccctgttgtgtccaggaaccaggcaccaccctcatttcttctntgatcaatctttaaaaaccagcagtgctcagctaactcttcatctatctcccccgacctggggctctgctgaatccacngctttagacccagctatcagctcggcatgtacagctggatgtccacaccgagctgctcaccctgtccccagcttcttcctcccactgtccactgcagaagcctcctaacaggacccctgctgctaccccggaccctgcaacccattcccacacagcagccagatgctttgacacccgaagtctcctatgaatccgatgaggcctctgcaccacancctcanttttacagaagtacaggggaaacaggggtctgttgacaccacagagatgcagctggccaaaggcagaantgtggggtacacgactgtcaaacgccaggggtccttacacgaatggtggaaaaaganggggcatgttacggatggaggctcgggacacatgggcgccgccttcccatgctgccagcaacccaccaggnaacctattaatttagtcatttgggaaatgggagctgggtatatcggctattaggaaattgttcatgctcaataagtattaattacaattttcataagagcttaacccccctgaaagaggtcactgtttcctcacttgtaaattgggatactaaaacctgccccatggagttgccagagtgacgtgtgtgcgtgcacaccaacagtacacagcagatagtgacatatgtgtgcacgccaacactacacagcagatagtgacttgtgcgtgcgcgccaacactacacagcagtgacacgtgcgtgcacaccaacagtacccagcagatagtgacatgtgtgcacgccaacactacacagcagatagtgacttgtgcgtgcacgccaacactacacagcagatagtgacatgtgcgtgcacgccaacactacacagcagatagtgacgtgtgtgcacgccactacacagcatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacagtacacagcagatagtgacatatgtgtgcacgccaacactacacggnagatagtgatgtgtgtgcacaccaacactacacagcagatagtgacatgcgcgtgcacgccaacactacacagcaggtagtgacatgtgtgtgcacaccaacagtacacagcagatagtgacatgcgcgtgcacaccaacactacacagcagatagtgatgtgtgtgcacaccaacagtacacagcagattgtgatgtgtgtatgcacaccaacggtacaacacgcaacagttgcagttgcctcatttccncaagtcgccctcactgcagaaaggggagtgtctccagctgcttagtccagcagcctccaggattgggtgagggtcggagggccctggtgccctgcatggacaaggcagtggcagcagggctgaaggacaggctggggtgggaggaccgcaaccctctgggatcgggccccacggtcagctcccgcagcccaggggagaggtgcccactctagcagccctttatgtgctcctcaagctganaagtagagaccccgctttgtgactacagtgagttctcacaccattaggcgaatggctggngtaagaccaccctgtggcccctgcagagctgacctcactgggtggtccaccgaagaggggatgggagggcaagtttnnnnnnngnnnnnnnnncngnnnncnnnnnnnncncntnnnnngcncncnngtaggttaggcccccntctnccgcgtcccctncccctcctcaccccaatncccatcccccacgcggtgcatcgggtgaaggggtggggnnnnnnncancacnnnnggctcagngctncccacagnctcntaccctcntgcccagcangtgcnntgnccagnccggncccctcctctgaagggtncttggcagaangatctccaaatngaaggtttctggtggcaggcccaggtgctggggccatacctgggggagctccaccccccggctgtaggtaggcaaggcccggattccagggnccagtgtaagatgacccaggtgagcccaaatcaggtccatctcttaacacaaggagctccctcggcacctcctgtgtgctacacaggggtcccagcacccatgcaggggagaggcctttggatcaccacagcccacactctgtacagagggataaactactgctttgcctgtagagtagccattcttttatttatttttttctttttcttttttttttttttttttttgagacgngagtcttgctctgttgcccaggccggagtgcagtggcgcaatctcagctcactgcaacctccgcctcccgggttcaagtgattctcctgcctcagcttcccgagtaactgggattataggtgcctgccaccacacccagctaatttttatgtttttagtagagacggggtttcaccgtgttagccaggatagtctcaatctcctgaccttgtgatccacccgcctcagcctcccaaagcgatggaatcacaggcgtgaaccaccgcacccggccctaacttttctatttttagtagaaatggggtttcaccatattggccaggttggtctcaaactcctgaccttgtgatccgcccgcctcagcctcccaaagtgctggaattacaggcgtgaaccaccgcacctggccccttttctttaataaatttgcttaaaaaaaaaaaagaacccanaggctgggcacggntggcttacgcctgtaatcccagcactttgggaggccgaggagggtggatcacaaggtcaggagagtggctaacacggtgaaacccntgtctctactaaaaatacaaaaagtcagccgggcatggtggcgctcgcctgtagtctcagctactcgggaggttgaggcaggagaatcgcttgaacccaggaggtggaggttgcagtaagccaagctcacaccattgcactccagcctgggtgacagagcaagactnctgtcntcaaaaacaaacaaacaaacaaacaaacacaccaaaaaccagaaaacccagaggggtaaattgaggcaggctggccgtgtgccaggccccagactgcagagcccagactccccaccgaaggctgagggtcgcgcttgctgtgtgaggctcagcaccttngtcaangtgcacccnacacggtgactcgtgggggtagcagcaccaagcactgcgccacccatgatgtagtcatcaccacctgaagaaaccaaggctgactccaacctgctcacagccacggtgtagcaatggcctggccagggnctcaagcccacccctcctcctcctgggaatctgggaaccccatgtttgagtgggccccccactgcaggacctctgctggcccttgcagctaccactgtacagaaggtgcacagggcagggccttgtccccaagaggctcggtgagtggaaggcacatggcatgaggaccgctgtgagccgcccgcccctcatccccgtggtggtgttccccaggctgcatcggctcaacagggggaggcagcctgggtcaccctagcctggtgggcactcgaaacgctcctcgaaggactcacaggccccatgggggccaggtaaggccgtgtgtttacagggagttggctcggggctgggtactgctgtgcacactggctgccaggcggcagctgggctggtttattactggaacaccctccccntgctcnctcctccccggggaggccagccctgcgccagcatctcnctgcaccagcccacccaccaggaggcgccntgtggggccactcttctgggaaagcgtngttcctggaataaattctggtttcgcttccaacaggaacaggaatagagctccctgtctggcctgccagggcagcttgcaggtttgaaggtcaagtgcacgtggctctctcctgggcccagcggcacccccttcttctggacaggggaggagccagctcctagaggggccacagtgccccagagggtgggttcagggtggtgcctactacctctgcggccccctgggcagcccctgtggcagaacaagggtagtgatatcaggcagcccagcctctccctccagaatgccctccctgccaccacctgccctaggagacctgagcacgcccagtggcttagactgagaatttctgggcttgagaagccttcgccatgatctggggtttccagccctgcccgggagctggctgtgcatgtgtgccgcaggggcagaggcctgacagaccaccaagaggccacgcccagtgccgccgcctttattcacagaccctcgagctccacagccacacagacacttagctttcagagggcacaggaaggaaaagggacctggtgaccctcccagcacaccccagagccaagacagacccagcagcagcacctcagggtcagcctgggtgcccctgcccaggggccactgtgaccgcagacaccaggaggccaggcctggttgctggggacccccttggggggcccggcagtatcctaggcccaaagagctggtgccatcttgaagctgattcagggaangaggccaggctggacggtaggggtaggtgtgagaagctccccagcgtgtccaggccacgggagcagcaagggtctgcggggagccnaggctggatggggtggggctgcccttgtcctgtatcctgaccacttcaaggacaaaaccagcccagtcccagcagcntgggaggcagcagaggctcnttcttctcccctcctgatcctgcagtggccaggggcaggagggtgaggggagaggagagaggtcagngtcagggcccctgggggccaggcagcttcaaaaatgcagccaggtggctgggggagggcaggagggtgggcagggcccagacccccatgatgggggcagcctgagacccccaaggatgaaggaagggggcttgggaaggagaggcaggcctcagccgtcagtcacgccagtgctgggatctgcagcccgctggagcaaggcacccccatcccaggggcaggnaccacaggacaggagggaaccgacacctcgcaccctgatcttccggaggccggggaggggcaccgggcgctctaggacttcttggcatcctgcgtgctccggcgcttcanggtcactcaggtcgatgggctngaaggctgccaggggacaacgcggtaggntggtgggcacaggcccctcctgcccatgaggcccggcctgccggcccagccctgcccccaggtcagcccccactcactcttcaggctggggttagggaccttctccacatactcctccaccaggccccgctcgccacccggcacctggcctcgcaggtctcgctccacaccctgccaggctgcagaggcagagagtggtgtgctcagggccccctgccccagggggtggcatccacgtcacgagagtgcctgccctcagctcctgccctcccagatcctcttctccctcagaagtgtcctccatgctcccccacagccctctgncccaccccagcctcactcacctgcagaccccgtccccgctcctctggcaggcctgtcccttccccgcaagatgaccaggactgtggtcagagggacccctatgaccctaccccaggcttccctgcgcctcggaggcagcgcatcctcctcagctaggcctctatctttcccacctcatccacgcacctccccggccccagcacacggcacactcccctaatcccagacaaccacctcccggccacttctgcaacacgcccgttcatggctggatgcgtgcctgtctgtcttcaaagngcccctccctttccccagcaaactcctccagtgctgctagcatggatgactggctcccagtgcggcctctatctgtggcatggcccacccccagcccctcctcccgggctccccccatgatcagaaccaggtctcctctctacacaaggtcccctcggccacccctacccgcctgggccctgaaggctgtggacacagtgatggggctatctgtgccctggaggggcaggggcaggggccgcaggaggttcctcggagcgtgggtcctgggctgggggcagagctgactccgtcaaggacagggcaggagctgtgtgtggcaggcgcacccaccttcgtaaatgaagcggacgttctcctcgtgggctggggtgaagatctcgnctgctgctgggtggggagcgggggctgctggtcctcttgccgttgtacacgactctggagacgggggnagctgggggagcctggcgcatgagacagggcacacagcagggtgggagcccacaacccgccccggtggagaccagcccacctgcctgagacccacctggtcatcgcgggggcgtctgatcctagcgctccaccgccagatcccctcagcctctgaaacagaagccagcgcaggcatgggacgcagggccaccctctccagcacagaaggagggggaggcgcagggcacacctgcctcctncccnttcagatgtgaacaaagtgcatggtccctctgcctaccagggtgtcccccacaggctggggtccagccacaggcagccagtgggctccaggcaaccctacgaggtagcagagagctggccagacgagccagacacacacacaacttgaagcgatcaagcccgctcagcggccttgatcctccacgtctcaggctcagacgtggaggcctcagccccagcaccgggagcactgtggccagagccncctccccacgtngggctggtggggccgtcagcatctctgatgtccagctgcctctcactgcagcagagggcctgcagcccctcagctaactgaccctgctctccctggtgcagggctgggcacacggcttctgctgagccttgatttcctttctgtaaaacggggatgagcttcctaaaggtgatcccagctnccccggcacctacccaggtccagcttcctggttccctagagcatgagccacatcagtaccctggagatggaaccaaactccagctcccctggtgggcagagggggtggccctggaggaagctgctgggcctgacctggtgaccaagaccctgggctgccgcccgtttatggcctcccagcccaggggaatccacggctctggaaaaatggagtctattttgaggctcagacgctcacactgngcaggctggacagtgtccccactccagctgaggacacacananccccaaggntggggaagctgacagggnctggtctccagcctgccctgctccagangggggcaactccaggttctgggggaggggagtcccaggattcccaggagggggctttgagcacaagcaactcccctgcccacccagaggcccaaggctgcagatactccagggcacacggctgcagccctcacagagggccaggagcactgaggcttcgagtcctcntctggctcattccgcctcatgtcaatggtccagccctcaaacaccacgtgataagaatcccacggctcaagggcaaaaccnagcaaagagcagaaaaccagctcccagccctggaactctgtgccccatcccaggccaggagtgaggtccaaaaagggccaggggctccccacccacggcagcacccagtttgctcacaaagtcacctctcctttcttggactctggggtctctctgcccagtcnctcctgccagggactccagcccacgaacaccagnagcacggagnggaaaggcctgtttgggttgagggtcccacagggacatgctgcctgctgggaagctcccgttacagagaaaggcagagctcaggtaacaggtagactggccagccccctgcctcgccccctgctggctctcaccactgaccgactgctgctttaggggtacctgcctcccagncctgccctctcccgtggctcttctccccatgcatcctctgcctccagtggccacttggcctttatgcagccacacctttggcctgggatccccctgctgggttcggttgtcactcctgccccagatcccactgattgccccacatcctcccaagcaactacccttccggggctccctttgccttgtgtgcacacacacacacacacacacacctgcccacacatacctacctgcacacaccttagctgaatacatctgccancacacatgcatacaaccgcccgcacacacctgtctgtacacacctgcccacacacatgcggcacacacccatatgaacacacctggtgtggcagcatgcacttgtagtcccagctactcagaggctggggtgggaggactgcttgagcccaggaggtcaaggctgcagggagccaagatcgtggcactgcactccagncccaggcaacagagcnaangacnccntgtgtcaaaaaaaaaaaaaaagcccaggcacggtggctcacgcttgtaatcccaacactttgggaggcagaggcgggtggatcagctgaggtcaggagtttgagagcagcctggcgaancatggtgaaaccctgtctctactaaaaatacaaaanttagttngggcgtggtggcaggcacccgtaatcccagctactcgggaggctgaaacaggagaatcgcttgaacccggganggtggaggtgcagtgagccaagatcgcgccaacgcactccagcctgggcgacagagcaagactccatctcaaaaaaaaaaaaaaaaaaaaggccaggncgtggntggctcacgncctgtaatcccagcactttgggaggccgaggcgggtggatcacaaggtcagngagttcaagaccagcctggccaatatggtgaaaccctgtctctactaaaaatacaaaaattanctggatgtggtggtgggcacctgtggtcccagctactcangaggctgaggcaggagaagtgcttgaacctgggaggcggaggttgcagtgagccgagatcgtgccactgcactccagcttgggcgacagagcaagactccgtctaaaagaaaaaaaaaaaaagccaggtacggttgctggcctattaaaataggcctgtaatcccnacactttgggaggctaaagagggcanatcacttgagcccnagagttcnaaaccagcctgggcaacatggcaaaatcccatttcttttatttatttatttatttatttatttgagatggagtctcgctctgctgcccaggctggagtgcagtggcgccatcttggctcactgcaagctccgcctcccgggttcacgccattctcccgcctcagcctcccaagtggctgggactacagaagcccgccaccacgcccagctaattttttgtattattagtagagacgggatttcgtcctgttagccaggatggtctcgatctcctgaccttgtgatccacccacctgggcctcccaaagtgctgggattacagtcgntgagccaccacgcccggccggcaaaatcccatttctacaaaaatataaaaactttggcaggagtgatggctgaggtggtaggattgcttgagcttgggaggtggaggctgtggtgagccatgatcataccactgcactccagcctgggtgacagagggagactctgtctctaagtaaataaatttaaaaccccataaatatatacacctattgtgcacccatacattttttttttttttttttttttgagatggagtctcgctctgtcgtccagggtggagtgcagtggcgcgatcttggctcactgcaagctccgcnctcccngggttgnacgccattctcctgcctcagcctctcgagtcgctgggactataggcgcccgccaccacgcccagctaattttttctatttttagtggagatggggtttcactgtgttagtcaggatggtctcgatctcctgacctcgtgatccatctgcttcggcctcccaaangntgctgagattacaggtgtgagctaccacacncncagctgcacccatacagttttttaagtcaacaaggagtctcgtttgcctcctcttgttaggaaaagaaatgtacccacaccctcaataccacaggctgtgtcctctaagtcttcccagacacgaagagcccttcccacctctccctacttcttcctccagcttagggacccccagggcctcacactgcccccccaccccccgaccctgcacacatagccccaggctttcctggatgtgccagcagttccaagaggccaggggcctgctgtccccctggaagcacaataaacggttctgcagctcattcagcctcactgcctcctggggccctgccaaggagctgggtgcccaattctgacccagaaggaattttccattaaaaatcaagtatctgtgcacaacctatgacccagccattctgctcctaggtacacacacccaagatgcgtacaaggacagctggagaatttcactcgtaattacccaaagggaagagccaccgcagaagggtagcaatgcacacctggcctattcccataagggaatcagcagccagagggggcaccacagcccccacgcagagacggacaccaagcacaagagcaggacctgaggggccacagacaggccctgggacacatgnaatgggaggaagctgcanagggccgaggcatggacataactggagccggggccaggacggtgcctgtgagggcaggaaggagccatccacggagagggctggaggtcaagcaagctctgaaccaagaggtcaccatggagccacaataaggcctccaacaacctcagcggggcggcctagcatagtgaggcacacagctgaggggggagggcaggaagtgtggctnggcaggcagctcagccctagctcaggcctgntgggcagcaggctggtgtctggctaagcagagggaaccctgaggcacaacatccatgcatggggtccctgaggtggtggatgtggagggacccagganccatagtgggtgagagtgagcaggggacaatggcacaggcccagagaagcgccgggggcagccggaaaagacccagcacacggcagacggccacctgaggtggcagcccctgagccagcaggagactgacacctcagctgcccaggtaaaggggagtggcggcctgaccgaggccgaccacaggtgaagggtgggagggaggggctccattncnnngnnccagagagacagccccacttcagaggtctcgagaccccatccagcccggccccctgccttcatcccacctgggccaccaccagggtgacagcagtaagggagggtcaggcgatgcctcggtcccgttttccttccctctttctgtcagaatcaagaccgagcatgccgatgtcccggccacggccccgtactcctcagtcgctacaccacaccccactgcctctgagagttttctttcatagttttcatattttaacatctttgaaactgggctgcgcctgacaattgctaacacgtcagaatttaaccaatggtggtttttatttctcaatgtactgtaaaatatagcgcagctcacaatggctggggtctcacatgggaggaccctcgatgacactctcctggcccanggaccacccttccagagcccctcaggctacatggtctttaggtgttttctccccttcccctcaaagtcttccacatcccacgccaccccaccccacccagtgctgggacaacctccagttccagacacccagcatcaggacaggtggacacagatgtctacatgatcttcctgaaaccctatccccaagtcacttagcactagggtgtcacccaggccctctgctgccatcaangcccactgtccagtcccaacttgttttaccaggtgtcacctgctgctccactcctgccccaacagcctttgccacaggactacctgccaccagccacacagagcacaggccacctgcaagtctgtgcattctgcaggacgtgactgcctgcttccgtggccgtccagcctacagggcctggcctactgggctgcaggtattcccctgctctggggccccgggcaagctcctctgagcctcagcatcctcattcaaagtgatgcnagcccacaggtaggnctcgcctgctccaatagggacggaagcacagccatggaaagccagcagctcagtgaggtctctgtggctccnttatccnatacgatgatggacaggacaagcatgtgctgtatggttcaactggatgctgttaagaatgaaaggggctggggccaggcgtggtggctcacgcctgtaatcccagcacgttgggaggctgaggtgggcagatcacctaaggtcaggagttcgagaccagcctggccagcatggtgaaacccncgtctctactaaaaatacaaaaagtagccaggcgtggtggcagtcgcctgtaatcccagctactcaggaggctgcggcaggagaatcgcttgaaccncgggaggcagaggttgcagtgagccaagatcacgccattgcactccagcttgggggacaagagtgagacttcatctcaaaaaaagaaaaaagaaaggggctagatgtggtggtaatcctagcactttgggaggtcaggagttcaagactggcctgggcaacatagaaagagccccatctcgacncaggtgcggtgactcacgcctgtaatcctggcactctgggaggctgaggtgggcagatcataggaggtcaggagtttgagaccagcctgggcaacatggcaaaaccccattgctactaaaaaaaaanaaatacaaaaattaggccaggcgcagtggctcatgcctgtaatcccagcactttgggaggccaaggtggaaggatcatctgaggtcaggagttcgagaccagcctggccaacatacagtgaaaccccatctctactaaaaaaaaatacaaaaattagctgggcgtggtggcacatgcctgtagtcccagctacttgggaagctaaggcaggagaatcgcttgaacccaggaagcagaggttacagtgagccgagattgtgccactgcactccagcctgggcaacagagcaagactctgtctctcaaaaaaaaaaaaaaaattagccaggcatggtggtatgcacctgtaattccagcttctcaggagtctgaggcaggagaatcgctttatacccaggaggcgcaggttgcagtgagcagagaccatgtcactgcactccagcttgggaaacagagacagagcaagactctatctcaaaacaaacaacaaacaaacaaacaaaaaagggccccatctctgctctctgccctcaaaaaaaaaaaaaaaaaaaaagaacgaaagggatgctgttgattatcaagaatgaaacaactcttctgggtaaactggaatgtagagtcagcccactcttaggaaggtggaggcccagaaaagcactggggactgaaagaagagactgccaccagccacagcaaacacttgtcgggctaagggcagggcagccaccacgctgggcccttacacacattgcccacatccccacagctggaccagaaagataccctgagaacttccagttcagcgctgaaggagcctgccaccaagcagcggtgcccctcccagggcctccggggccacagcatttggggctcagcccgaatgctgcagctggcctgagcctcccaaagtctgcctccactcntgcctgcaccctancagcaggtttctggactccctgaaagacccactccctactgatacccatgtggctttgctcagagactggcccntccctccagatagggaggggagtcgcattgggtagaactatgtagaaccttcctcctccaggggacccaagggctttagagacttccaggtggggaggggacagaaccccagtctctggcctcccagtcccaaattctttcccccacacagccacatgcctaagaacaggccatgaggtaacactccagcaacgtgacaatagtgaggttccagagttagaatcagtgacgccatcgctagtcaccatgctcctccggagtttctgagattcaaagtttctaagactccactttctcttcgtgttntgtgtctttttcagccaacgaggctagaaaatgatctattgcccaagcaggcgcacgaggatacggntgtcacagctgccacactggcacctcgtggtcccttgaagaccgcccagggaaagcctctaagcgctgcaccacctcctcaccctctcccctgggtggtggcagcaacagcctgagcgtgtgcgccctcctccccatcctgatcccactcaaaccacaacctcccntgactcgccccaaatccagccctgttggctcttccttcacgtcccacttcccaccctctctacacgttctcgccacatcccacccaaagtccactcactggtccctgtttacacctcagggcctttggtcaagctgtcttctctgcccaaaactatcctactcatccttggggatccagctgaaagaccancttccngcgacngctacccangggcaggagggagagaagcacagcccgtgccccgtatggctcccgcccccgcggtcacaaccaccgcccagtgagtgcctanaaggcaggcggaggccccgttctccccgttaggcccagcatcaccgcccggggagacgggaaagagggcaaggccnaaaaatggacagaaaaagaatgcggacggccgggcccgcggcgctccgagaatcggaggcatcctcaggnacggtccctccaggagaccgggaaagcggggctctgtcagccccnaagccccgacggcggcagaaggctggcccgctgcgagcgtccggcggcgctgggtccccggcacctgcccctgcctgggcgggaaaggcgctcagtccgagccgcgccctccccacgcgcgctcccaggcgccccgcgggccgcgccctcctgcaggtgccgggcggggaacgcgggcccctccctcggaccccggctgcccggccactcccccgcgcncggncccgcccggccctgcanggnacccgcggccgcgcggcgacaccanggcggggnccagncgngnccgncnngnnnnntnnngnntcnngnnnnnngngnngntnnnnnnnnnnnngnnncnnnancnnnnngnnnnnnnnnntncnntnnnnngnnccnncnnnnngnnnacnccncnggnnnnnnnngnncnnnncnntnnntnnnncnttnanannnnnnntnnaananggnnnanncgnnnncnnnncctnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacacatccctgtagaccattgactggcccataggagtcttagagcggaattaaggctccgattattcctcctttcgtcggagcagcagtatctgagaagagaggaaggcacttccctcccaaaggccctcctagagtgatctggagaacggcgacgggggaagtctcagaaatcacaggcatggtcaggcagggtcccgaggataagagcggcatagtggggaagaggtaggcaccgtagcctgcttctcagcggaacagtcccgcgtggctcgagtgggccggcggatgatgcccggccacctcagagtgcctcagcggtaaagtcgtccactacgagcatatgagtgtctcgagaggccttggagacaccgggggacacgcgccctccgctagttgcagagggcggtccgcgcgcccatgcctgtgatcccgccttgcggaacagtccgaaggggcctcccccgcccggccgagcagtgcagctgaggccgcgcggcgaccagagggcgggggccatccgcgcctgccaggccccgggtcttccggggccaacgggcgctgcacgaggatcaccttgccctgtccaggccgccaccgcctcttnnngntnngnnnnnnngnnngnagtgnngccaccgngggctgcacaggngcaggcgcagcgcnntctcacgtgnccgcccggctggcggagggcgggggcggccgggattcccgtgcggggttggggctcgtggcggaagctccggacctccctggcccgaacggtgagcgccgccgnccactgggagcggccagagcccagtaatcaggacaccaccacagggaccacgtgtgtagacccaggccccctcacctgggagtcacgtttattgaaaaagtaaaaagtgtcacagtaaaaaattcacctggggacaaagccaggcctaggaggggtggcggggtcgtggagggacgggtccggccgcccctggcccacgggtggggcacgtgctggcccatgggcgacgcgcggcttctccagggaggcggccctgggcgcgggggcgggcgggcaaagctggctcagtccatcgtggtccctttgaagagctccaccagctccttgtagtccgggtcgatgaggtcggagggcaggtcgccatcgtcgttggttgcatccctgtccgctcccagggagataaggtacctggggtgtaaaggtcgctctggctgaagcggggaggagccaggagagtgctcgccccaacccgggtcagagggccagagtcctggggtcacctgtgtgtcccccaccttggggtcctaaggtccgggtagggtgaggaggaagaaacctgaccctttggaagctgtggccagcttttcaagttggttctattgaggacaaaggcagaaacaggattccagaagcctctagggtttgcagggttcntttttttgttttttttgttttttgagacnagaatttcgctctntatcacccanggnctggagtgcaatggcatgatctcgactcacggcaacctccacttcccgggttcaagtgattctcctgcctcagccttgagtagctgggattacaggcgcgcgccaccacgcgtggctaattttgtatttttagtagtgagagggttcttgtcacgaactcctgaccntcaggtgatccgcccacctcggcctcccaaagtgctgggattacaggcgcaggcgtgagccaccgcccccagcctctagggttcttgccgacaccacccgggctacattttggggctcccatcctggggacccactgaggcccggaggggtcgggttcaagcctgtgtagacccagggccccctcacctggctatgtcagggtacccatcgctgncaggcaatgtgcaggggtgtccagcccgcctcatctcgctggtgaatgtcagccccgtatttgaccagcagcttcacgcattccnanggttnccagagagcacggcttcatgcaangcngccaggcctgggcagggaggacgggaggggtcaagactnngccccaggtcaggtcctccttgctggcctctcccaccaccccacaggccctggccagctcttccaggctttgctcacctgaggggtggatggtggccagggagactttccgagtccggatgaagcgccccacctgctccaggtcaccctgccggatgtggtccaagaacaggacatcattagggaaacgcacgctgcgatcagccagcatccgccgccgccgctgccgtgggctgtagcgggcatagcgggcagttctgctaggcatcttgggcgctgtggggcaggttgcccctggggaccctactgcactggggttaataatgtatccggtcccgaccagatcagcttgagggctcctgtcggacgagccccggcctctgacttgcttatatagggctcaggggctatataaagctgcacggtcatcctccccggcgcgaggggctgaaactgagctgcacccccgccccgcaccccagatcatgtttagtgactcatctttcagcccatctgtcaccgtgcccggccaaaggggtcagatcattcctgcctgtcgctccctgccccacagnctggacctagaaggtgccttaccgagggcaggaggaggcaccggtgcagaacccatgagatagctaggaacgcgagatcaagggcacagtaggtaccaaggtcattggaagggcttttgctctctacctcctggaaagtgaggggcggccnaccccctccacatctgcagaagcacaggtccaccgtgctgtggtgaaacaggccttagcccctccatctcccntacctgtcnagttttcaccttccagcgtggcttgcctcactctcagtggttttcccaaaactactctgatggcctaggcaggcggatcatgaggtcaggagatcgagaccatcctggnctaacacggtgaaaccccgtctctactaaatatacaaaaaattagccgggcgtgatggcgggcgcctatagtcccagctacttgggaggctggggcaggagaatggcgtgaacccgggagngcggaggttgcagtgagccgagatcgtgccactgcactccagcctgggcgacagagcaagactctgtctcaaaaaaaaaanaaaaaaaaaaaaaaatgactctgatggtgctgcctcctgctcagaaaccccgcaggcatccttggctgggatctcagtgcctcaggctcctgctcagtcagtcctgcgacttttcctccacgtgcctggntcccctgcctcacacacctgcaggggacagggtattccctacacactcatgggttcaccctgcatagtgtctctgcattccaggtttgacacacatactcacacttaaggtggtgtccagtttgctctccacgttcagggaccatcacaccctgggtggtgtgctctctctgccccggcccctgtgatcttacctctagangcacagccaagggaatttttttgtttgtttgtttgagtcagagtctcactctgtcgcccaagctggactacattggcgcaacctcggttcactgcaacctctgcgtcccgggttcaagtaattattttgcctcaccttctcgagtagctgggactacaggggcatgcaccaccacgtctggctaatttttgtatttttagtagagacggggtttcaccatattggccaggctggtctcaaactcctggccttgtgatccgcccgcctcggcctcccaaagtgctgggattacagacgtgagccactgcgcccagccaagggaatttttaaaactcgtgttccaacaggctcttcattgctggctgcctttacttttgcaacagccccagtggaggtccaaagtagggcttggactacaggacatgagnaagtggatgggatgggacacagacacagagttgaccagggaggtctttgttgtcagggacagcgatcgattgtgctaggagcactgcagcacttgaagctggatggatgagtctgccggggctgtcttcacagaccacagantgagtggcttaaaaaacagatggttggccaggcgtggtggctcaaccctgtaatcccagcactttgggaggccgaggcaggtggatcacctgaggtcaggtgttcgagaccagcctgaccaacaaggtgaaaccccttctctactaaaaaatacaaaaattaggccgggcacggtggctcatgcctgtaatcccagcactttgagaagccgaggcgggtggatcacgaggtcaggagattgagaccatcctggctaacacagtgaaaccccgtctctactaaaaatncaaaaaaaaaaaaaaaaaattagccgggcgtggtggcgggcgcctgtagtcccagctactcaggaggctgaagcaggagaatggcgtgaacccgggaggtggagcttgcagtgagccgagatcgtgccactgcactccagcctgggtgacagagcaagactccatctcaaaaaaaaaggccaagcgcgttggcttacgncctgtaatcccaacactttgggaggccanggcaggtgnatncacgaggtcaggagatcgagaccatctggctaacacggtgaaaccccatctctactnaaaaatacaaaaaattttctgggcatggtggcaggcgcctatagtcccagctacttgggaggctgaggcaggagaatggcgtgaacctgggaggcagagcttgcagtgagccaagatcgcgccantgcactccagcctgggcgacagagcgagactctgtctcgggnaaaaaaaatacaaaaattagctgggtgtggtggcaggcgcctctagtcccagctactcgggaggctgaggcaggagaattgcttgaacccaggaggtggaggttgcagtgaactgacatcacaccactgcactacagcctggggatggagcaagactccgtctcaaaaaaaaaaaaaaaaaaaagacggtccgtcccagagctctggaggctgaaatctgggatccgggtttcagcagggcaggttcctcctgaggctctgaggagcgtctgtcgcaagcctctccccagcttctggtgccgccagcaatcctggtgtccttggccctagcagcatcgccacgatctcggccttcatctccatggtgttctcccagcctttgtcactgttcacatcacccccttgtataaggacaccagttatagttgggtattgcctcatcttaaccagtgacatctgcaagcatcctgntttccnaacaacggtcacattctgaggtcttgagggctaggacttcanacgttaattaaggagacacatgagtcaacccataatgctggtaaaaccctgcaggtggtcactaaaggcctgaatgaggacagaaccaagactggccagcagctctttgcaggggcagaggagagctgggccaccaacagcctcgcatcattaggctgatctgcatccaacgaaatcaaatcagcaaacatattagacacctctaggtgcaaagccttggccaaatgctatgggagggctgggcacagtggctcatgcctgtaatcccagcactttgggaagccaaggctggagggtcagttgaagcgaggggtttaagcagcctgggcaacatagtgagactccntttgctttaaaaaaatttaaaactggccgggtgcagtggctcacacctgtaatcccagcactttgggaggccgaggagggtggatcacgtgaggccaggagttcgagatcagtctggacaacatggnagaaaccccccgtctctgctaaaaatacaaaaattagccgnatgtgngcggcgtgcgcctgtaatcccagctactcaggaggctgaggcagtagaatctcttgaacccgggaggcggaggttgcagtgagccaagatcgcgcgactgcactccagccntgggcgacagagcaagactccatcttaaaaataataataataaaaaatttaaaaaataaaataaaaagagtaaaaggaaaaatgctgctggagaagcggcgctgacggagggtccctgcctggcgaaatttcctggacctgcgttggtacccaggtgcaccccctgtcccctcccctgccccctgggcccctcgcctcgggtacaccacctctccagtcacacactggagtggccctggagcctctagccaggcccgggcctgcagacaccctgaggggggtcggctcccagcgtggctgcatttctagggactcagggaaaggtatggacagttggaattccaggtcacttgggaggagccaggccgttttttctggcttgtttacgtgaagcctggagacgaaacgttgtacactggagacaggctctcctctgatgtgaagattgccttttctcatgttgtggaaagttctgtctgccctcccccctcagaggatcagatgaaagcacgctggatgaagctgccaccaacagtgtgacgagaaggaacgccctttccaggagtgaccgggcctcaggctagagacgcggtgggggcaagaccacccggtgagcctgtttggcgaccccaagcaagcccctgtgtccctcctgctggaggtgagctgggagcgtgcagagcttttggctttggggtttctatctggatcacccgagggactggtgcctgaagcctcgccagtcacaacagatttccttgaaaggtatttatgtgccttctattctaataaggatgtgggaaccgtgtgttctacgccatgatagacactccctggagctcctcacccttgaaacgttccatcagaagccggccgtcagcagtcgtgcctgctccaccgtgggcgaagcgtgctgttcatgcagcgtgacgtcagagccaaacctgtcttcatggagttttgtccctgattncttcttggtccatatgaacttgcaaattgacctagtttgcatgactctaagtttctgccttctggaggacgaactagaacatctgatgcacaaggtttaccatcnnantttntntattttttttnnnagacggagtctcgctccgtcgcccaggctggactgcagtggtgcgatctgggctcacggcaagcttcgcctcccgggttcangncattntcccnnctcagcctccngngtagctgggactacaggcgccngnccaccacgnccagctaattttttgtattttnngnagnangacggggtttcnctgtgttagccaggatngtctctatctcctgaccncgtgatccgcccgcgtcggcctcccagagtgctgggattacaggcgtgagccaccgcgcccggcctaccgtccaacttttagaagtccagtgaggcctggctgggctcagaagctcacgcctgtaatcccagcactttgggaggccaaggtagaaggatcacttgaagccaggagttgaagaccagcctgggcaacatagggagacccccttcccttcaaaaaatttaaaaattagccaggcatggtactgggtgcctatggtcccagctacttagaatgctgaggtgcaaaagattgcttgagcccaggagtttgaggctgcagtgagctacngtcncnccantgcaccccagcctgggcaacagagcaagaccctgtctcaaaanaaaaaaaatgtncngtgaatgcanccagcagtgctctgcaaaagcacccgggagaccctgttagtaaagtcagctgaggccaggcgcagtggctcangcctgtaatcccagtactctgggaggccaaggtgggtggatcaccngagatcaggagttcgagaccagcctggcnancatggtgaaaccccatctctactgaaaatacaaagattagccgggcatggtggtgcatgcttgtaatcgcagctactcaggaggctgaggcaggagaatcacctgagcccaggangcagaggnttgcagggagctgagatcgcagcgctgactccagcctgggcaacagagtgagactatgtctcaaaaaaaaaaaaggaaaagtcagcgcaggtcgcactgcagtctggcaggagggccagcctagggccagaagggcccttccctccctgagngtcagaggccccccggggtgtggtacatagacccagcaatcactgttttaggctccaggccggtggcttcctggcacctggagagacagagggttgggaagtcccaggctgctaagccctaaccnacctcctcccagagccttcaaagtctccccactaatccagcagcccagtcagagaggttttggacactgccccaccacctcccagccacagccgagcccaggaatgtgctcatcagctgcctctgcaaaacgggaaaggtatcagtgactccctcccctttccagagcacatgacaccagtgctgcgggcagctgtgccatgtcccaacgnttctctccagagggccggctccccgcacagctggtccacagggtcactgcaccccatcccnacggccagggagcacaggcacaaatacagcccacccctttagctgtgactcaggacagcctccctcagagaccctgcaaggagccacagccctcgggcctctgcccacatcctcccacggcacctccagatgccgttgcccacttttccgtgagtacgcggctcactgtgtcgcaggacccaggcatggcacacaaaccctgctgaggccctggagctgaactagccnagaaaccagccccagcacgggctgtctccaagacccacagagctgggggccggggcagacggcagcacccagactgccgagctggtgtgagccgtgtggggccaaggacatgtgggcaaaccngggctggctggtgctggcgacgtgttgacacaggtcctcgcggcatgctggccggatactccacagcctggagcagaggcaggaggagccggagcggccgagtttgtgagggcctgtggggccggcaagggaggtagcggggagaacgggagaaccgcacccccggcgaggcctggtctggcttgagagccgtctctggctccagcagctgcagccagcccgcnaangctcgggaactgggaggacacccgggaantctcggcagtgcggaagctcctactctaggaagcacatcaggatgtgaagttggcggggctcacagagtcacaggcagggctcnctcaaggcagcctggtgagggtcgtttgttccatccgaacttctgagggccgagcagcctccctagagctgcagctccacccccnacntncccacctgccacctgcacccttgggctccttcctcctgcctcaccgccctctgagaccaccatgagccctgctggatcctcagggcctctgccgttgccctcagggggacccacagacaccacagagctcctgttgcctcccctgcagaaaagcagcaaatccaggctcagcagagccatcgcccagccctgcacacaggccgcggcttgccgtctgcagaaaaattgactttcagccgggcgcggtggctcacgcctataatcccagcactttgggaggccgacgcgggcaaatcacgaggtcagccagcagatcctggctaacacagtgaaaccccatctctactaaaagtacaaaaaattagccgggcgtggtggcggatgtctgtaatcccagctactcaggagngctcangngcaggagaatcacttgaacccngggaggcggaggttgcagtgagccaagacagcaccattgcactccagcctgggccacagagcaaganctccgtctcaaaaaaaatcgagtgtatgtgttttttctgcatgtgaagcacaggagtgctgaggttaagccaaattnacaacttaaagaccaggagatccttatttttagagacagctctgtcacccagctggagtgcagtggcgcgatctccgctcactgcagtgttgacctcctgggatcaagtgatcctcctgcctncagcctcccgagtagctgggactgtaggtgcaaaccatgcccagctaatttctaatttttcctagagacggggtctccccgtgttgccccagcactgggattccaggcgcgcgtccctgcgcccagccctgccctttatcgtgtgaagggttagtgataagcagggccccctgttcctctcacccatccttgaagcctgagtccacctgatttctcgtcactccacggcggggatgggagggaatgaccaggagtctgagcatcacatggggctgggtggctccacnccgtgtccacatccnagggtccagaatcacagaagccccatcagagtccaggtaaagcagcctacaggncagggaaggcatcctccccngggaantcgcaagcctgcacagctctgctggggagactggggcctgtttctgcatctgcacctcgtcccaggggcgaggcctctcagcaccagtaaccccactaaggcctggcagatggccttggcgtccgcattccagcccagctctccgggcttggtgagatcataaacccgaggcaaggacaggtggtaaaatttcaactttatttggccaatgtgttcaattcgattgtgaaatagaaatgcctgaagaactgtcagcgtctgattcagctccagcatccttggccacctccccacccgggagtcaagggtcgtggttctgccttgaacaggccacaggccgtgctgtagagaggccagtggtcacaatgagcccacgacaggaggaggagccctggcttgagggaaggggaaggcccaggcctgtgccgggccccagggctggcagccaccagcntcctcttccaggcatgggggacaccctgacaggatccggaagtctccatttacccaaaaatgcaagagccatgatcagtcatggcgacactgcaggcggtactgagtgaccatgtccagtccggctccgtccctcccacacgggggacaagcttctccgaggaggcctggccaaggtggaacaaataccctgatgtcgaaaaatgtctaaaaatcccacagacggaattttcaaaaagaggaganaacctcccgcgggagggaggcagcgagactccgaacacgngtagcaagcactctggacagactcatgtatgaaaaagtacatcatggtttcaggaaacaagccccaccagggtgggctgcctggagatggatccctttccaaaaaccgaaaagcagaaggaagagacgggggtgaacggacggtgtgtanggggtgaggtgtcacttcagagaggttccctgggntttccggcgacgccctccttcaagcgaggccgcaggcttcggaggcgtgcgctgctgctgggtgtgcagcccccgaggggtctcggcagcgcccgggtnctggctttgcgtattacagttcatctttcacagctttctgatcatcgtcttcctccatgtctggctcctctgcttcttccaggtcctcgagatcctgggatacaggaaaaggggcggggcgggcaggttggctgcaacagctgaggctgccggcccccnagcaccccacactgctcacaccggggactagccggccacggcggacatggccaccggccactggagcagccaaccctggtctttacgagctacacaggggtcttcccnaggaagagtgacgcctgggggatttctgcctatagcaggatgaatcagagcccccactgtgtcaggaaccctgggaatcccagctcagccttggacccttccactgggcatggaaggcgtatgtgtgtctcccagcttggcaccatggagtctacagagggtccacatctcggcagggacaacagccccagcatgaagtccaggcacagtcaccactggggtgtgaccattctacttccaacccttgggctctggccaatgacaggccacaggcagcaccaggggccggccctccatccccagcctgggcagagtattcccacctcccactgtgcaccagcactcccagcaggccctgccagcctgggctgaccatgccctcatctccttcaccatggtcaagcaccccgcccctgccgcatcctcccaacaccagcncttcctgcttccccggcagagtcaccactgcntgctggccacgcgctgacgggcaggactaaactcccgagggcagacccatgtctgcgcccttgtgcccgggccccgccagcgggctggggatggacctctgagtccaagttagcagcatgtgaggaaccggtgccatgtgtctgaaaagngttttctaagcaaaatctggtttttaaagatgccttcaacgtcgtcccctaaagaagtgctggccagggagagctgtttcagcagagcactgggagcacatcccttgccctgctgggcgnaaggtgtnggggccccagagccctggacgcacagacgtgcctccaatggcaccattcccatcacaagccgagcccaagtgggcatgtcccgtggggccaaggggctgaatcccagagaccagcccagggctgtgaccccactcacgtcatcatcccctgccccatcctggccaccgctctccanggaatttcttaaaaccatccagcgtgcgttccccgttgtaatcaatgacctgtggaagacagggatgagtgcagggngctggtcccggcccagagccaatctcctggcattggctcctcctccctagagaaaggcagagcaggcccggtccgngtggctcacacccggaatccagcacatntngggagttcaaaaacagcctaggcaatatagtgagatcccatctctctcgaaaaacaaaggtgggtgcttctgaaggagctcccacagctcttctccncacctgactagccccaggctccttccagagaggcacccaggctggcgtggggaccactgctcttcccagagcccgccccagccccgtctggagggaaggcgcaccgtcctgtcggcactggcaggaaagaacttgagtgtggggaagctgtgcactttgacggcctccancctcgttggcagtcgagtccatcttggcgatgacgatgttctcatggtccttgtacgtctctcccagtttatcccaaatngggagccaactgtttgcagtgacncacaccatggggcatctgaaaagaaagcagttctagggtgtgtcctggacacaaagccactggcagacgcttccccaggagtctgcctaccttgcgcgtgccctggtggcacggacctggggagctgaaagggcaacacttacagaactccacaaagacgttttttttctcatcaaaagccacgtcttcaaagttcttcccaacaagcaccttgacaggctgcttgtcccagtcctccggcagctcctggctcatcaggtggggctggagggcaggcagggcacggtgaggggcggcgatgcctgggggaccacagagctccccaanccctcaccctgcccgggactgaggtgcgtggctgccctgggcacaccagggtggcagccgcagacaccaacagtgccaagaatccagaaagagaaggctgggccagtgggctgggcccaatgagcccacgcaggccgcaccctcgccggccaggaggtttccctgaggagcatctgggccagccgtgtggacaagagggctcctacaggtccccaaaggtgtgacaagaatggtggtcttcacaccatcttgggctccgtcctcttactctgaangatcttactttgaggacgaagcccaggacactgagagcccagagaccccaaggtggcggctctacccgggaggcagccnctggcccggggacgcgcctgcaccttgattttgccctccaggaangcggtggcagaactctgtgatcctctctgccgtcagctcctccgattcgggcttgtacttnggtcatctcctccntcncagggntgatgaggcgcacggccgggcactcttccttcttcanggccaaagaactcgaggatgcgctggttgtcggtgtggtcgctgtcgatgaagatgaacaggatctgggggagaaaaggaggttgcacaggntgcgggagacggctggcctctgcctccagccctgactttgctcggaagcagaccgtgctccggtgcctttttcctccaacctggattccggggttgcccaaccagaccagcaggtgactgggagcagaggtctggcctggnctggcccctcgcctacatccaggctgtcctgaatcaggtgcccgatccagtccagcaggcagcctcaggaaggccccacacttgtcacctcgggaagagttgtactgctccctggcaccgccccacgagccacccagaagagcagctcaccttgcccttgaagctctcggctgctgttttgaagttgctcagtttgccgtcatagtcagacacactcttgggcaagaacagcaggatgtgagtcttgatttcacctccaaaaatcttcggggctgtctgtgttataaacttaagttactgggtctgagtcacacactattaatgcagaagattctcccaatggcctccaatgtcagacgctggacagcagtggtgaccgggagcctcatgccaccccnnaacccactcctnccccatccccagcctgggggctgcagggcagccgcacctgctcggtgaactcgatgacaaggggcagctggttgtgtttgataaagtccagcaggttctccttggtgacctccccttcaaagttgttccggccttcatcaaactgtggacagaaagagggccctgactgagcattgctgctgggagcacagcccctgggcccgggtctccctggacgtgggaagtcacagcagccagcagccctgccctcccgtggggtttcgagccacaggtccagcaatgggtacaggacatggctgttcctcgacagtaagactggctctggtcacggccttatggctgcccgtgaattcaacagctggcttcacatccacaatgcaagcctggcgcacgtggtcctccagcaaccttgaagtgtggcccatccccagggcccctagccttttcagggcacccatgtggtcaaagctattttcttttttatttgtttttgagacagtnctncgnctctgttgcccaggctggagtgcagtggcatgatcttggctcactgcaacctctgcctcccaggttcaagtgattttcctgccttagcctcccgagtagctaggactacaggcgcctgccaccatgcctggctaatttttttttgtatttttagtcgagatggggtattaccatgttggccacgaaggtcttgatctttttttttttttttttgtgatggagtcttgctgtgtctcccaggctggagtgcagtggcgtgatctccactcactgcaagctccgcctcccggattcaagccattctcctgcctcagcctcccaagtagctgggactataggcgcccgccaccaccggctaatttttggtatttttagtagagatgggtttcaccacgttagccaggatggtctcaatctccttacctcgtgatctgcccgcctcggcctcccaaagtgctgggattataggcgtgagccaccgcgcccggctggtcaaagctattttcacactcacacttctctggcctctgccttttcactctccctctcacgtgctgcggcacagacccacagaggctgctgggcgcatggtgtcgcaagagcaggagggcaggagaggagaatcctgctggaggaatctaaaacatcactcagcactaaattgtttttgtctgggacaaactagtttccgtaaagatgtgatttatgataacatgtaatgggattattattcttttaaaataaatttggctacagtggctcaggcctgtaagcccagcactttgggaggccaagatgggtggatcgcttgagaccaggagttcgagaccagcctggccaacacggtaaaaccccatctctactaaaaatacaaananataagnctgggcgtggtggcgggcacctgtaatcccaggtacttgggaggctgaggcaggagaatcgcttggacccgggaggcggaggttgcggtgagccgagatcgcaccantgcactccagcctgggcgacaagagcgaaactctgtctcaaaaaaaaaaaaaaaaaaaaaaaaaaggccaggtgcagtggctcacacctgtaatcctagcagtttgggaggctgaggcaggtggatcacttgagttcacgagtttgggaccagcctggccaacatggtgaaacctcgactctaccaaaaatacaaaaatttagctgggtgtggtggtgcacacctgtaatcccagctgctcgggagactgaggcagaagaaacacttgaacccgggaggcagaggttgcagtgagccaagatcgtgccactgcactccagcctgggcaacagagcaagactnctgtctcaaaaaaaaaaaaaaatacaaaaatacaaaaatcagttngggtatggtggcacctgcctgtaatcccagctacttgggaggctgaggcaggaggattgcttgagtctgggaggtagacattgcagtgagatcgcaccactgcactccagcctgggtgacgagtgaaacaggccaggcgtggtggctcacgcctgtaatcctagtactttgggaggctgaggcgggcggatcacctgaagccaggagtttcagagcagcctaatccaacatggtaaaacgtcgtctttactagaaatacaaaaattagctgggcgtggtggcgggtgcctgtaatcccaactacttgggaggctgaggcaggagaatcgcttgaacccaggaggcggaggttgcagtgagcccagatcgtgccactgcattcgagcctggcaacagagcaagacttcatctcaaaaaataaaaaataaaaataaatagagagaaaaaaacgattttttacattcttagttctagtttctaatacaacagatcctgaaaggcgcaatccacgtgcctgtaanggccctggggacccctaataatgcacggcagcttcagggagtcctaaggccacaagatggagaggctgtggcgccccaaccacgaggggtcagcctgcagctgaggatgcggcctcggctcaggctcagagaggcgcccctgtgctgaggctcttcaagtgagaattttgggtgagccttccatcattcccccgaactacttttttatttatttttaaaatttatttatttttttattttttgagacnggagttttgctattgtcacccaggctggagtgcaatggcatgatctcggctcactgcaacctccacctcccgagttccagcaattctctttcctcagcctcccgagtagctgggatcacaggcacccgccaccacgcctggctaatttttgtatttttagtagagacagggttttaccatgttggccaggctggtcttgaactcctgaccccaggtgatccacttgcctcggcctcctaaagtgctgggattataagtgtgagccactgagcccggcccaaactattttattttttttttgagacggagtttcactcttgttgcccaggctagagtgcagtggcaggatcttggctcactgcaacctctgcctcccgggttaaagcaattctcctgcctctgcctcccaagtagctgggattacaggtacgcgccaccacgcctggctaattttgtttttttagtagagatggagtttctttctnccatgntggtcaggctggtcttgaactcccgacctcaggtgatcggcctgcttcggcctcccaaagtgctggaattacaggtgtgagccactgcacctggacagaactactttttnaaatacttatttatttaatttattttattttattttatctattttgagactgagttttgctcttgtttccctggctagagtgcaatggcacgatctcgatcttgcctcattgcaatctccgcctcttgggttcaagtaattctcctgcctcagcctcgcaagtagctgggattataggcatgtgccaacacgcctggcaaattttgtatttttattagagatggggtttctccatgttggtcaggctggtctcaagctcctgacttcaggtgatctgcccgccttggcctcccaaagtgctgagattacaggcgtgagccagcgtgtccagccaaaaaaatttattttatttttactttttgtagagacagtcttactatgttgcccaggctggtctcagactcctggcctcaagcaatcctcttgtcctggcctccctaagtgctgggatcacaggtgtgagccaccaagcctggtccccttgaaccttttttttttttgagacagagtcttgctctgtcgcctacgctggagtgcagtggtgcttctcggctcactgcaagctccgcctccntgagttcacgccattctcctgcctcagcctcctgagtagctgggactacaggtgcccgccaccacgcccnggctaattttttgtatttttagtagagacggggtttcaccgtgttagccaggatggtctcgatctcctgacctcgtgacccgcccacctcagcctcccaaagtgctgggattacaggcatgagcccctgcacccggcctcctcaaacttcttaaatgagacttggggaaataaatcacgcatcctttcttactggnccgtttccatgtatgcgtctgcagagtaacttagagaccaggtgccactccctgctcttgtgcacgctgtgcctgggccaccctggcctggcctgactgccaaggagctgatgttaaaccagggcacaagcaccaaccaccctgcccgaacccgaggggcagaggcttctaagcctgctacctcttccccagaggggcaaaggcgggtaaggagaggcagaaaagccaagttcaggaggcccttggagggaatcctttggaacatgagctgctgatcacagccgtgctcccagtggcacgggtgggctcgcactgtgcccaggagtaacgccgggccgcaactgcaggcaaacgaaatccccccacccctgcagaacaatgtctctgactccctccagagtgtcaggcgccgcctacaccatctcatgccaagaagccaggnaggagacactgccgcagctgtcccagggctgccatcgtttcagcagagatgctacaccacactcaatcacggtctactgcggtaagggaaactggtccacttagcagggcacagcagcaggaggccagccctgccaggccacgngtgacaaacagcatagaaacgcccaatgcaggccgnggtggtatggctcacgcctgtaaccccaatgttttggcaggctgaggcaggaggattgcttgagctcagaagttcgagaccagcnctgggcaacnacggtgaaaccccatttccacagaagtattaaaaaatagccaggtgcggtggtgcacacctgtggtcccagctactcagcaggctggggtgggaggactgcttgagcccaggaggtcgaagctgcagtgaagtgtgattgtgccaccgcactccagcctggtaacagagcgagaccctttctcaaacaacaataacaggcccagtgctgccagctgggggagaagaaaaagtgaaatatcagaagctctcacacccatggtgccagtgaccagcagcccccgcagaggttttcctgggttgcagtgcctgctagggaaggaagggaagagcaggcaagagcgggccacacaagagcacccgactcagccaggctgcccactgtggccactgcacacacaggaaggcctcactcactttgagggatgggggttaacagcctggtggnaaaaggaacaagttggactcatcctctcagctgcggggtgagctctgacttccagggcagcccctaccacgtgcaccggacagggggccgggcttctgcccggagctgccntgcaacgaccacgttcgccatcacagacacctgagccaccttcagtgggcaggaaagcgccacccaccaactggcatcaaacccaagtgggtttgtctgtgcccagctctagtggactccagagaatggagacagaacgttaacctgtggggagcccacatggatggccacgtgtgagcctttgcaggcaagagcaacgaaaccnaccctcccagccttcgcggacacatatcaccaaanctgtccatagagtcacagcggccactgcagacatccagggcactgaaggagctgtgggctgtgtgacaacacagnggttcgcgagtttcgtgggctctggagaaagtctgccccagaacccaagtttcanggacaagacttggaactttctctttaataaaagctctaaaaagacctttggttccttcaactttatccaacacttcactggctttttctagtcagaggtttaatttcctgggcaccttgcaatggcaatagactaatttagcaactctcttcccttcaggggacatcaagagaatgtctcctggtaaagagcatctactgtcttgagttatctntgaggaagtggctgcnaaaacagctaaatgacaagaacaagaacatggaagcaagccatcctgacccacccgcaccaccgcgctccaggaagctggctctaccctccctcctacctggtcccggggagtgctggatgctccgtgcttactacagaaagtgaatgggtcggtggctcacacctgtaatcccagcactttgggaggccaaggcaggcggatcatgaagtcaggagttcgagaccaccctggctaacacggtgaaaccccgtctctactaaaaatacaaaaaaattagctgggtgtggtggcgggtgccctgtagtcccagctactcgggaggctgaggcaggagaatggcgtgaacccgtgaggcggagcttgcagtgagctgagatcgcgccactgcactccagcctgggcgacagagacagactctgtctcaaaaaaagaaaaagaaaaaaaaaaagaaagtgaatgggttccttgtgtccaaaaccactcagccccaatcccagaggctgcccgtctgaccgtttggcttatgatgctgctgtctaaaaggttcttctcccctctggaaacgacacangacaggagctganaggtccgatcgcccccggccgccctncctgcccctcactccccaggtccctcctctcccgagactttctctcctatccacactaccctggctctgagcggcacaaacccaccatcacccacatccaggttcagctgtccctagagcacaagtgtgcggccccagccccacctgcctggtgaccgagaaaagagacaatagaaacccacaggccccatcttgacactgtgcaaacaaggaccctgctgtgtcctggtaacgggnagnngcgnnnaanangccacactgtccaggagcccttccccagnagnaaggacagcgggatcangatggcagttttnncacagtggatccttangggntcataatgcccttggggctgaggggcatacgaagtgtgggtgccacctgggtgggaacacgcccagagcgccaatactccagacctctgggtaaggaaaacgttctggaaatagggatgctgcaggacgctctgaatgtagttaatactttagaatagttaaaacgtggccngggcgcggtggctcacgcctgtgatcccaccattttgggaggctgaggcaggcagaccactcggagctcaggagttcaagaccagcctggacaacacagcaaaaccccatgtctaccaaaaaatacaaaaactcagcccagcgtggtggcacgcgcctgtagttccagctgctcgggaggctgaggttagaggatcacttgagcctgggaagcagaagttgcagtgagctaagaatgcaccaccgcactccagcctgggcggcagagtgagaaaccctatctcaaaaaaaaaaaaggcaaacggggccaggcgcggtggctcacatctgtaatcccagcactttgggaggctgaggtgggtggatcacgaggtcaagagattgataccatcctggccaaaatggtgaaatctcatctctactaaaacaaagattagctgggcatggtagtgcatgcctgtagtcccagctactcgggaggccgaggcaggagaatcacttgaacccaggaggcggagggtgcagtgagccgagatcacgcaactgcactccagcatgggtgacagagcaagactctcccaaaaaaaaaaaaagggcaaatgttgttacatgnttttatcataattgaaaaaaaaaaaaaagctaacagtcaaaagcagttctgaggcggctgtggcaggagagtggccagaaagcccacagctgaatgcgaagaccaggccacaggcatcagcgcaacaccccaacttggcaaagctgcagaacatacctattgggccaaaggtgccaggagcaaggttcccttaacgataaggagagcaacgccaccctctgcagaccaaccccagaactaacctgggcagagctgcctggggccactcaccttcttaaagaggacaaccccatctttgtcgagctggtatttggagaacacgtcactgttggaagtgatcccaaatggtatgtcatcgatggcctctgctgcctgcaaaaactgcttggcagagtccgactccacgtcctgaatgaggnagggagaagcagaggtcgtcatgatcccgcagcaccaagcagtagggcagaccctgtagagcccaggccaggggggacacgtgcagaactgccagctgcaggctgtggacccctcctcaatggatgacggaaggaaggaagactggaatgctctggtctctaccttgaagaagccgatgacagccacctcgnctggactccaccaaggactctgcagctgcgccgtcaggcagggtggtggcagccgggcccgtgcgcttcttcagccagttcacgatgtcatcagcctctctgccagctaaccccaaacaaatgtaggttctactctcaaacagggagtgccgcctgccctgccgcgcctgctcccgtctctgctctctgccagccaggctgaggacacctgaatcaacctaagtaagatgttctcccaccatggaagaggcccggtgccgtccgcccgcctcctaaaccccagtgtacgtgagacntgtggttgtgtttatggggagtggagangggaangagnggtgattctgtctctgaataacaggatcacaaacccattttttttctctgatctctctgcattttcttttttcttttgacacaggggctcactctgttacccagctggagggtagtggcagaatcttggctcactgcagcctccacccactgggctcaagcaatcttcccaacctcagcctcctgagtatctggggtacagatgcacgctaccacacccagctcatttttgtatttattgtagagacggggttttgccacgttgcccaggctggtctttaactcctgtgctcaagcagtttgcccaccacgacttcccaaagtgctgggattacaggcatgagccaccaatcccagcccttttttttttcttggaagacagggtcttgctctgtcacccaggttagagtgcagtggcatgatcatggctcactgcaacctcgaacttctgggctcaagcaatcctcctacctcaggctcccaagtagctgggaccacaggcatgtgccaccacacccaactaacttttttttttttttttttttgaggcggagttttgctcttgttgctcaggctggagtgcaatagtgtgatctcggctcactgcaacnctccacctcccgggttcaagcaattctcctgcctgaccctcccgcgtagctaggattataggtgcccgccaccacacccggctaatttttgtatgtttagcagagacagggttccccatgttggccaggctggtctcactcctgacctcaggtgatacacctgcctcagcggtctcccaaagtgctaggattacagaggtgagccactgcgcccagcaatgtttcttcttttttttttttttttttgagacggaatctacctctgtcgtccaggctggagaatgcagtggcgccatcctggctcactgcaacctccatctcccaggttcaagtgattctcctgcctcggcctcccaaatagctggtattacanggcgcccgccaccatgcccagctaatttttgtatttttagtagagacggggtttcactgtgttggccaggctggtcttgaactcctgacctcgtgatccgcccgcctcggcctcccaaagtgctgggattacatgcgtgagccaccatgcccggcncnaatttttctattttttgtagagatggggttttgccacgttgcctaggatggtctcaaactcctgggattaagcagtccgcccacctcggccttccaaagtgctgggattaccgggnatgaaccactgtgcccagccctagctaatttttgtattttttgtagacagggtttcaccatgttgcccaggatggccctctgcattttaaaaattttattttttgaaacgaagtctcactctgtcacccaggctggagtgcggtggcacgatctcagctcactgcaaccttacctcccaggttcaagggattctcctgtgtcagcctcccaagtagctgggattacagacgtgcaccaccacgcccggctaatttttgtatttttagtagagacgggggtttncaccatattggccatgctggcctcgaactcctgacctcaggtgatccacccgtctcagcctcccaaagtgctgggattacaggcatgagccaccgcacccagcctgtcctctgcgttatctaaattttctttgacatgtacatccatcaaacacatgttctcacccaggagtctgacagcaggcctcattttagagaggtggacagtaactcaaaactcagtgccagttttctacctctgggaacaggctgacgccccgcccacctgactcccgcgcctcctaacttatcccaggcgtttcgggagttctcgccaatggcccaccctccatgcctcccagaccaggaagaagatgacacancttttatgccaccaaaggcggtcaactgacaggaaagaaacttcctcctcctgggagactgaggctaaggaatgatgcctctcctttttccctcctagaacttgactccctggtccgaatcgggaaaaccccattcagatgtagaaggattccaccagtgctaacaagacggtcaccagtgacaagtggatttaggagtgctcatctcatctgcaaacctgagtgttagtgacagaaccacggtgactttggacagagcacttcccgttccaaaagtgaacatgagtaaaaaatgagaacatcaatcacgcctgtaatcctagcactctaggaggccgagacgggtggatcacgaggtcacgatcgagaccatcctggccaacatggtgaaaccccgtctctactaaaaatacaaaaattagccaggcgtggtggtgcacacctgtagccccagctactcaagaggctgaggcaggagaatcacttgtacccgggaggcagaggttgcagtgagcagagatcgcaccactgcacgacagagcgagactgtctcaaaaaaaaaaaaaaaaaaaaaaaaaggaaacatcaaaacagccaagtgagaggcaaccacagagctgctgccactagaacaggacagggcacacctgcttaaggggacaaaaggaaacatcaaaacagccaagtgagaggcaaccacggagttgctgccactagaacaggacagggcacacctgcttaaggggagaanccctgctaacactggaatgagctgctttcgggctacccancatgagcatctgacatgccacagaaccggntttatagacgagttttcntttgccaccgtcactgatctggctacacaggggctcggcctccactacggcagcttcagaggcggcagacgagcagctgagggcccgtgctacagacggagcagggcgggcttggattcgaggtctgctaccgacaggctcgatgctgttactcagctgctctaagcctcagccctttgtctgggaaaagcccgcctcacagagaggatgcgaggagaaatcacgcaagcacgtgacgcggcagctggcacgctacacacgacagctagcaggtgtcaccccgagagctacagccatgctgctgctcctaggnaacagggggcagcacaaacagcccatgtggccagaaaggcaccagtcntccctctcctcgctggtcagtctccaaacagacctcagccagccgcccccaggatggcaccagacaagacaggttctccattcgaaggttcttccaggatgaaaactcctcacaagaccctcagggcacaagtggacagagaacccggcctgaggaacgggatccctccaagcctctggaacccggcctccccaccgctcagacagctgcccctgcccttccaagtcggcaggccagtccctctctaaagacagttcaagggcagtgccacagccacacctgtatattccttgggggaagccgtgtctccattcctgaagaacttgatggtgggatagccgcgcacgccgtactgctgggccaggtcagactcctccgtggcgtccaccttggccaacctgatctcggaaccttctgccttcagcttcccagcggctttggcatactcaggggccagagccttgcagtggccacaccaaggggcatctggaagcggaaatgagatgctagaaagcagccttgatccctaaagcagccttgatccctcagcagtgcttccctttttcctctggcatttcccttcataaaaaccttatctactcaccaagataacccctcctaacgcacaaggctgagctgatagcctggtgttcttgggcaatatcaggacagaggccgntgaacgacaaactaccaccnaaccaacaccagcccccactctgctatgtcaccatcagcacagccagacaaacctttcaatggttgctgacttcttattccccacaggcaactaaggcaaggatctcccctagacntttccctttaagactacagacaaaagtgaagaagtgaccgtggcggcctgtaccagcactagctgtgagtatgagatgcacatccgtgcacacagaccctgagttgcttagggtgagaataagacgatctgtcaatagagttagcagcntgtgtcaggcacaaggttcccaccccagggacagagctcaaatccttatggacgtgaggaaggcttgggattctcctctgagacaccatcggaaggactgctgtggcaagctgaaggtggggtgggcaggagcggggcgccttccgggtcggcccccggggangganctcggcaaggctggacactggcttgctctgtttgctcacacaggtcgatccntgttcttctcgcactaacaggaagatcctgccgtgcgcagggcgggcatcgggacggccccccggnctcccagcccggctctcacccccagggagcccctgacatggcccccaaggcgggcagcaagggagcccttcagttccgggcgcgccgggggtcccgaccccgggggctgccgggccgtgcctgcgtcccaagagcctggctcagcggccccgagccccgcccgcccgccaggcccggcgctcacagaactccaccagcaggtacttgtgggccgccagcgcctccgcgaagttgcttttccgcagcaccaggacgtggtcctcctcctcgggggcgtcggcgcgcaccagggcggccacggccaggcacagcagagcgcggcgcagcatgtcggacacggatcaggcggggcgcttcggttggcgccgccgggacagcgggggcgacgagagcgcgcgccggtcccggcctcgcctttataaatcctgggtccggggcgcgcctgcccccccngcccgcgcgcgctggccgcggcgcgcacgcgccgctggggcccgccttcgattggccggcggacttcgaggctcgtctttgccgctctcggattggacactcacaccaggcctggccccggattcggaaacgctcctgagtgctccctggccttcgttcgggattggccgaggacctcgcgctcgctgtctttcttagcctctcattggctcccgacaagaactttttctgccttggcttctaattggtggctttcgcctgcaccttccacgggtctggaatggctgcccctttcggtagcacggactctgcgcctcctgattggccaagggatgcgcgcactctgcgcgttccttcgtcgaacgtggcagtggggaggagttcccagtttaggggcggagctgcggctgcgcttccgaaacccctcgtgttgcattctgactggaccgcgtacccaactggcacgccccccggcccccggaccggaagttggggtgacgcaatttccggcgcgcgtgtcaagcgtgcggcggcggccgtggaaggtggggttggccgcctagggtcggcggtgggctcggtgtgggatagccggcccggtccgacgcgctccgcgaggtcacgcgagacactcaccgaggcatggcggcagggcctgggcatgggaatcgtgcgcacagtgcgaggaagcctcggaggggatacgagcacagggcgggtggttaggagaatggggctggagagacgggcgggaggggcgggacctgggccccggggacctgccggctcccaggccccaggaagacgctgctcatgcgtggagcggccgcaggaaaggtactccccgctaaggccttcagggagcggccctttgccctgtgcgatctcttccttcctttcccacgggttgccaaatcctgtgacgctgccccttctctggtgcttctcagatgctctggtcggctcaggagacctcgcagctgttacacagctgtggaaataccctgggcgctgcttcactccgaaggcagcagctgggtttgcctcccgactcgacccgccaccgaggctcntgagcacttgaaatatggccagtccacctgagacgggctgtgagtgcgcaatgcacatcaaacttctaagactgagtgtgcggggccgagtgcggtggctcacgcctgtaatcccagcactttggaaggccgaggcgggcggatcacgaggtcaggagttcgagaccagcctgatcaacatggtgaaaccccctcacctcccgtctctactaaaaatacaaaaattaacagggcctggtggcgcgcgcctgtaatcccagctactcgggaggctgaggcaagagaatcgcttgaacccaggaggcagaggttgcagtgagccgagatcgcgccattgcactccagcctgggcaacagagcgagactccatnctcaaaaaaaaaaaaaaaaaagtgtgcgtgtaggggctggaggacagaaggtacagtatttcgttaataactttacattgactactacatgttgaaatattctgtatgcatatgttggattacataataatattgaggccagngtgctgtgtggctcactcctgtaatcccaccacttttggagaccgangcangaggatcccttcagcccaggagttcgagaccagcctgggcaacatagtgagactcccgtctctacaaaaaataaattaaaaaaattagccaggcacggtggtgtgcacctgtggtcccagctacttgggaggtggaggtgggagaatcatttgagcccangaggcngangctgcngtgagccatgatcccaccactgcactccagcntgggcgacagatcgacaccctatctcaaaaaatagtaaaaaantgtccttttttnaaaatttttattttttatttttttgagacagaatctcactttgtcatncaagctggagtgcagtgggcgatctcggctcactccacctcccggattcaagcgattctcctgcctcagcctcccgagtagctgggattacaggcatgcaccaccatgcccagctaatttttgtatttttagtagagacagggttttanccatgttggccaggctggtctcgaactcctgacgtcaggtgatccacccgccttggcctcccaaagcgttgggattataggcgtgagccaccngcaccnnaggncctcctcttctatcttttaacgtggcttttagaaacttttaaaattacatagatggtctgcattttgttagtgttggacactggcagccctccgtctccctcactgcctggaatctgctgctctccttttccccaggtgcctgccctctccattcctcctcactttcctccgctgggaatcggcaccgccactgattttaaagttgaaacttggcaggcaaaagggaggtactcccatgttaaatgtatacacattgactgcnaatagtatcctgacttttgaaatggtaaaacgtagagtaagttgcttttgtactttgagagtttctgttntgttgatcagttgttcctgagaacatgcttctccttccgacagggaactccctccactagaatatgagctccttgtnggtcaagactgggtcccctgttcccttccccccagtgccagcggangcaaaggtcagtcagcggcataagttgtacctgctgggagaactgtctgcttcctccgggtgacttttctggccaagaaggaatatgagtatgtgcctccctgagcactggcctggagcccactcaggaaacaccatctcttcataaatggttttgattgcaggncattgttccttctgctctctggatgatggaaattgcttcaggtcactgcactatcttccaacgtttttgtggttgccatgagctgttgtacagaccacagtttggggcctgagacaagctgggcatggtgttgcatgcctataatctcagctactttggagggtgaggcaggagaatagcttgggcccaggaggtctaggctgcagtgagccatgatcataccactgcacttctgtctgcgtgacagagaccctgtatcttacataaaaccccagcccatatttgtaccacatctagatacgaggtcagagttcagatgcctaaatattgtagcttgtgttttgtccacntgttgggggaagagtgaagagatttgacataccataatgttgattagcttgtgatggtttggcggcagcttaggccagagcataaagtaaaaaggaaaagtgttcacagacaatgaanaactgggaccaagtggtgaatactcaaggcacacagaccaggcaaggatcccagtggccgtggatgagtctcaggctggctctgggccagtggaacacacctcagtgtgggtgaaggcctagccagggtagcagagggcagggctacagaacagcagcccaggtggctgtggccgacctgacattctcctgtgaaaatcaggtgcccaaccagcactaatctagatagatggcagcattttttttctttaaagacaggatcttgctatgttgctcaggctggtcttgaactcctgacctcaaaggatcctcccctcttcagcttcccaaagcactggggttacagatgtgagccagcacgcccagccgaatcancagtatcttagacagatgccatggctgcccatagggtcctctcaaggtgcctctgcccttggactggcttcctacaccaacctgacaggtgcagcaaaggtggactttctggtaaggctggaggaggaagcctggtctgcgatggcctgagacgccctctatgggggttgttgagtggatggaaatgtgcagggcatgggtcctgcccccnagaatgcaggctggttccgctgggncacctgcagagggctgatgtccttttcctgaggcctgctcctgtgccttctaaccctagggtgagaagatgggctgtgttcacctcatgcccaggcccttcgaggagtgtgcccttgggggtcagagccctcctgtggctggtatttctttggatcatcancaggtgctccnagacatcctttagggagtctcaggcttggtgaagggatccattaaatgttgcttagttggtttttgtttgttttttgttttttcgagacagagtctccctctgttgcccaggctggagtgtggtggcgtgatcttggctcactgcaacctccacctcccaggttcaagcgattctcctgcaacctctgcctcccaggttcaagcgattctcctgccttggcctcctgagtagctgggattataagcgtgtaccaccaacccntggatgatttttgtantttttagtagaggcagggtttcanccatgtntgtcaggctggtctcnaactcctgacctcgtgatcctcctgcctcggcctcccaaagtgctgggattacaggcgtgagccatcatgcccagccaactggtttgtgattaaatgttttgattgatgcagtttttgaaatgtactgntgtgtacaatattactcttttgagacagggtctcactctgtcacctaggctggagcacagtggtgcagtcatggcccactgcagcctctgccttgtagccntcaagtgatcctcctgcttcagcctcctgagtagctgggactacagttgtgcaccaccatgcccacctaatttttatttttttaaagatggggtctcctgtgttgcccaggctggttttgaactgctgagctcaagtgatctgcttctggccagctactactcttaaaagtagagttctcagagcaaaacagctccctttcaacncttcagtccggtcgaaggtgtggtgggggtaacaacagcaggctcatggatacctgggcagtgctccgaggtccctcctgtgttcccactgagcagcagcctgctgtgcccggagtggaggtgagaaatccagcagcagcgcggtggtgagtgtgggccctgcggagtgtggcaggcgctcattatggtgcagggcagtgttgggcacagagaaggttctcagaaaccacagtaacccatggttagttnggtcacatcccagaccctgacctagcactggctnggcnactgtgacttgtcactctcctgaatggaagaagtgtccacctgggggtggctgaggaggtggatgctaggggactgctgggagccacggacctgtggaggttgggagaggagactgcaggcgcaggctgctggaggcgaggaggcctctctggagcgccaggccatacaaacaggtcccaggtggggccacgaggatcaggttagacttgggacccgagagacacgtcatgcccactgtgcaggtgccacctcatgttatcctgcaccagggngaggggccagcccaaagtcctggctgctggcagcatgcccgtacagcttggcacctgggtctgagttcacatgtctagcaaagctgggaaaatccaggagcaagaaggtgaagccctttggctcagcccaagctcagaaggcccttgcccgatgagccgaactgctgacaacaccctggcactgggcttggggactcccctggagcatgtaagaagtgaactgggagcgtgggagaaactgtctggcaggggctgctgcctcnggagctcatcctccctggctgtgctggtgtctgtccagtgggattagcctccatcnctgtggtttcaccaccccaccgcctctctcccccacagcacaggcagaagcagcaacgcaacacgagaccacctcgcttggggctagtagcagttctgggaaaggctcggtagggtctttgctccctgcggaatcaagggctgggggctgacccaggctttctctatagctgcttccagatctgggtctggaccagcttctgcaggaaggcaccattctgttggggtgtctgacacggtcagctctaggctcagcctctgcggcccccacaaaggcctagcaaggatggggcaaggtggcagtggtgcccgcacgcactgccctggcacaggtgtgtagttagtgacctgaagcatgagggcatctccctgcccaccccagctggagataagccccttgcggggcccaccctgctgatnaaccccagagcagtatggcctgtgtcagaatgaccagtaggagggccccggggtagcagctgcccagcccagctgcgtgtgtgtgtgaagtattttcctcnaacaccttataccacagaaggcagattttgaaactcgcatcaggccagaaaaagaatttctgaatggacacttctaaggggtgcctggttactcatctgcctcttccccctgcagggtagaggggcatgggtttgaagttcccgggggctcttggagactgcagacacggacgagctggggttcctggatgctgcagcagttggggcccctggctgagcgcacctgccccaggaggccctgcgtggttcccnccagtagccccttcacaccacaccgcagtgaggatgccctgtctcctgccgatcccatcacaccaagcctnttcgctgttgggctcctggcactgcccgatcctggagggcacttggctgcggctgtggctgtgaagggctggtgctctaggcgcctccgtggcccccgttgcctgggcacctacttccntgcntcagccacagctgcatccacgtgcgccaggggccacaaggccgaccctggcttgggcctgttcctccctgggtttccttgggatccagtcattggagggcccgcgcacagctgggccaactcgacacctccaagcccggccagggaatcaagcagctctccctctggcagcatgagctacacaagccaggcccgtcttcccattcccttagcaaggaggggcaaccccagccaaggccttctgcactgttctagactgttgctgcctagggctactgtagctgggagtcacattcctttctccccagatagttgcaaggggcccagcagccacagcanttcaagggggccctgcccttcccctcccaccaccccaccagggtccccatcttcccctttgtctcctaaagcccgtgaggcagtagaggagccaggccctcccctgccacaccctggnagaagccaagcagcagacacccccagctccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctgngctgggtcagggaaggcctgccgggggtggtggcactgagagcctgggggaacaggcgccaggccagtggcccagggacggcacggacggaggcaataaatactgatggccaggcggggctcctggctgggcccaggtggggtgagtgaggctgtccatcgagggctcttgggggggtgtgggctctgggcactgcccgctgagacagaaaaggcagaggcaggacaatacccagcctcctggatggtactgaggtgacttgagttttggcaatttggctttccccaagccgccgngagccatctccacagccctgtccagggaagggggcaggctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcggggctggaggacggcccggcccccacgaggccgtgcatcccacaccccagctccaccccggagcagcagacgcacacgtccaggggcaaccacggggcctggagaatggctgctccgctccctcctgaagccagncntcgggtgtgacggggagatagaacntggggggcacagaaagggcagcagaggcctggctgcggcctctctcccccacagcacaggcagaagcagcaacgagacaggagaccgaggaggctgggcctgtgggtgggggagggctgaggaggggggtcggaggcanctcggttgagccaggccagggaggcggaccagggtgggaggggcacggagggcctgtcagcactttggtatggggaggggaggggctgggggggnacacatnccngccnngtccgtcgtccgtccgtcagtctgccctgcccgcctctggctgggctcagtccttccagtccttcttgatggtgagattccactcccaggacaggtggtcggtctngtcgtcgtctgtgaagcgggacttgatgctgtagctgccccgggccagcatacccttgggtgcctcctccacgggggtcaggaactcgtactcctcggcccggggcccatagctgcctaccatgtagtcagtcttgtcaactgcggcacaanggaagagggcggtcagcggccccgcttccccgccntggcagcacgcacccaagcggccccctctgccctgcccggggccccactcactcttgacgcctttcctgtacgtatgctggatgtacttcatgccggacactatctctcggttaacctgcaggacccgaagcgaggatcagggaaggtcggtccggaccccagccccagccccgcctccattccctggccacagcagcctgtagcttacccggaaagagatttttatccggtactccacaccctccttcagcacaaacgactgcttcttgaagctctccaggtcgcctgttggggggacctccccctcaatgactgcccagcagccctgcgcgaagccccagccctgcgcggccccctggctgcacttcccgagatccccaccaggggccgncccggacccccgcggccgcagggncactcacccgtcaggtccagctccagggggcccggggccgagctgcacaccagggtcaggccagtcaccnacgacgttggggacgttggggtctggggagtgacagcaggtgagggccccacccccnaccagtggaagtaggggctggggagcggcaagacagctggagtgaacgggcggccacccggctcccgcagcccagactcacctgcggaaancggccacgcggcccagcagggcctccttgtactttcgcaggctctcgtcgtccttgtccagctcctggatctcctggatgctcttctgggccgggggcttgtagttngaccgagtgctcatcctccnntcgttctccgctgcaatctgggccagctgctcggctgtgggctcctgctcagccatgctcaagcttagcctgggtcgggacacctgtgggcgggacggtgacaggccttggacctggatccccaacggaggcgcacttctgagcaggagtgtgggctgcagccggagctccaaaagggctccaagggggccaccttcgctcctctccacccccgcgattcctgctcaggggcatcctctggggcagtgtgaggtgcccccaccccaggtatnaacatctaagacaaaatgggaactgcagccgatcatggggagagaggacacacctccccctccacgatggaggaggcagcagccccctgtatgtgtggggcggggctagcaggccccagaatcaaccggcggggcccacactaaaccctctcttagggtcttgccgctcttgagctgcccaggccctcgccctacggggtaacggggctcggtatccctcagtagggttgctcctctggccgtggtagtcacatgtaaacgtgtgtggtcggctcagcgtcatctttcaaacaggatgcccctggagctcggatgttaggggcagctagaataccgcacggggccacctggacacggggatcctaagtatctgcggtttctccacaattgtgaggntctgtgacctacaacttgggagctaccacagccactcagtactctcgggcccntctngtagatggtgggcccngagtgcccggggcagcactgacccggcaggggatctgtcaggctcagatccttcccggcagcgtgggaggtgggtcagggagcagcacacccgggacacccaggccggggtccaggccgccctgcttcctccaggggctggggcctccgcgccgcgcgaggatagccgtaggcgccgggatcctagggcgcggcccncacttccgcaggncccgcaatccgtgccgggcgtgncccgggcgctgggggaggccgngccccaatcnccgcgtcgcccccgaacgcgatggaccgcggctgccggcccggcgccncccgcgtccccaaggaggggccctcaggtctggcccgggccccacgngcctcggcggccatgaaagaagctccggaccgctcgggaggggccggcactcccctggtccccgccgcccctccggcccgggacccgcangtggggccggggccgccgccgcccggtcccgccccggccccgccctagcccgcaccgccctggcccgctgtcaccgcgcccccgcccgccgagaccctgccgcgggctcagggcggggcgcgaacaaaggcggaagcccccacctcagcgccccccgcnncnnnngnngnngccngncnnnnnnccnnnnnncnnnnncnncnnnncngncnnnncnncncnacnncnnnnnannngnngnnnnngccnngcnnnnnnnnnnnnnnnnnnnnctnnnnnnnnannnncgnngnnngcnnnnnnnnnnnnnnntnnnnnnnnnnnnnncacnnnncntcnnntnnnncnngnnggnnnnnnnnnnnngnnnnnncnncnngngnnnngncnngnnnnnnnngnnnccnnnnngnnnnnnnnnnncntnnnnnnnnnnnnnnnggnnnnnnnnnncntnannnnnnncncnnnnnnncgnnnnnnnnnnnnnnnnnangnnnnnncnnnnnnctnnnnnnnncnnnnnnnnnnnnnnnnnngnnnngngnnncnnnnccnnnnnnnnncnnnnnccnnnnngnnnnnacnnnangncnnnngnnnncnnnnnngnnnnggangcccgngnngnngnnnnnnnnnnncnnccnnnnnncagtcggtccgactgcgactcttgcttcggggcctagtcacctagtcccgnganttcggggaggtaacgggcacggggattaagttctngttaaacacgggcgagagcgntggcgcgcggnccgttccagggccttggtgtcccccgtggaaagacagggctgtggggctaggaggagccccttgcacgccccgcggaaagcngntgctgggcgagggcgcagcggaggtgtttttctccaggctgagacagaannnnnnnnnnnnnngngnngnnnnnnggngcaggcgccgntgcagaggccctagtgtccntgaggaatcccgcggctcctcaggaccaggaggcagggagctcctggcaccgtgagcagatgaggggctgcctcagcctgggcttcaccgcagagccntgttccccactccgcttgttcngagattccacacattcgcccacaagggccgtgttgaagtatcaggaacggccgcataacgtgagtggcctggcccagcagcagtgctngcacccagccccgggctcgcctntcctggaggccaagcccntaaatgccntgcaccagacactgggtgggacgctgccccgcgtccagcctgcagcacttgttaggactgtggactcgttaacgtggacgcctcttttatttatnganttgattatttttttgagacgtagtctcagtgtcgncccaggcttgagtacnatggcacaatctcggntcactgcaacctccacctttcaggttcaagcgattctcctgcctcagcctcccgagtagttaggattacaagtgtgagccaacatgcccagctaatttttgtatttttagtagcgacagggtttcaccatgntggccaangctggtctcgaattcctgacctcaggtgatccacccncctcagcctcccaaagcgctgggattacaggcatgaaccaccggggtgcccaatctttttttttttttttttttttcttcaagacagggntcttgcntcttttgcccaggnctggagtgcagtggtacaatctcagcttactgctgcctctatctcctgggctcaagcagtccttccacctcagcctcccgagtagctgggacntacaggtgtgcaacaccatgtccagctaattttttattttttgtacagacagggtctcactatgttgctcaggctggtcttgaacccctgagctcaagcgatcctcctgcctcagcctcccaaagtgctaggattacaggtgtgagccaccatgtccggccacccagcctcttttaatcactcttgagctccatgcagacagggccctgtctgtttggcccatactgccaggcaacccaggctgatcaagagaagtggagaccacacgcacacacacacgcacagctgctttgttcagacacagacatgaacacaggagggcatttttggggacagaactatgcaaaataccgagcttggtgtcttttgaaaatttctgaatgttggagggatatttgagagtttctgtaactgagtcacactgtcagtgccatgtcatcagcacangcgtttcctaatcaggtgtgaaatgcttcanctgttaaagactcagagcccctgtgcaggtgatcatgttgcccaactttccaataacccaagtgcttttaaaaaaaaactgttgggccgggcgcnggtggctcacgcctgtaatcccnagcactttgggaggccgaggcgggcggatcacgaagtcaggagatcgagattgtcctggctaacacggtgaaaccccgtctctactaaaaatacaaaaaattagccaggcgtggttgcaggtgcgtgtagtcccagctactcgggagggtgaggcanggagaatggcgtgaacccgggaggcggaacttgcagtgagtggagatctcgccactgcactccagccggggcgacagagcgagactctgtcaaaataaataaataaatacataaataaaagattcgattgtgtgggtatacattttgtttgtaaccattccagttggcaaatatttggtttcttttttgtccattatgaataatactgccataaacatttacgaatattataaaccattataaatgttgcattaagccttttcatgaatatgtgctttcatttctcttgggtagattcctgagtggaagtccccaaatgttttccaatgtaggtgtgccactttgcaccccctagcaacgctgggctgctccaggtggccacaggctcagncaatacctgctgtgcttgatcccagctgtacaagtgtgaagcagtgtcgtgtcacactgtgagtcgcacctgcacttccccaatgagtcttcctgggcagaaaccntatttaaatcttttgctcatttttaattgggctgtctgattaagctatgagtacttacatatcctgtatacagtcctttatcagatatatganggctgggnntgcagtggctcacgcctgtaantcccagcactttgggaggccganggcaggcggatcacctgaggccaagagtttgagaccagcctggccagcatagcanaaaaactgtctctaccaaaaatacaaaaattagccgggtgtggtggtgcacgcctgtagtcccagctattcgggaggctgaagcaacacaatcgcttgatcccagaaagcagaggctgcagtgagctgagattgccccattgcactccagcctgggcaacaagagcaaaactctgtctccaaaagaaaaagataggtgatttgcagacattttatgtggtttgtctttcattttcttaatgatgtcttcttaagggcaaaaccttttattctagtgcagtagttttttccacatggtgcatgcctttgctatcctaagaactcctngagctgaggtagngcggatcacttgagcccgtgatgtcgaggctgcagtcagctatgattgtaccactgcactccagcctgggtgacagagaccctgtctcaaaaacaaactcttagcccaaccggatattgtaaagattctctctcatattttttctgtgatcttctgctatattttatgtttgctgacatttagatatacagtccgtatttgggttaactttntcgtatggagtgaacatcttttctgtgtgtaggaacatccacctgtcctggcaccccttgttgagaaactatcgtttccccnaatgcaatgtctcaccacctttgttgaaaatttnttcaccataggccgggtgcagtggctcacgcctgtaatcccagcactttgggaggccaaggcaggcgcaacacctgaggtcaggagtttgagaccagcctgcccaatgtggtggaaccccgtctctactaaaaatacaaaaattagccgggcgtggtggcacatgcctgtagtcccagctactcgtgaggctgaggtgggagaatggtgtgaacccgtgaggcagangtttgcagtgagccaagatcgtgccattgcactcncagncctgggcaacnagagcaaaattccatctcaaaaaaaaaatttttgttcatgtaaatcgaangggtttattacaaaaattagctgggcatggtggcgcacacnngtagtcccagctactctggaggctgaggtgggaggatcacctgagcctgggaggtcaaggntgcagtgagctgtgatcatgccantgcactccagccttggtgacaaanggagatcctgttgctgggcatggtggctcatgcctgtaatcccagcacttngggaggccgaggtgggtggatcacctgaggtcaggngttcaagaccaacctggccaacatggtgaaacgtggtctccactaaaaaatataaaactagccaggcatggtggcacatgcgtgtaatcctagctacttaggaggctgaggcaggagaattgcttgaaaccgggaggcagaagttgcagtgagccgtgatagcgccattgcactccaacctaggtgacaagagcaaaactctgtctccaaaaaaaaaaaaccaaaaaaaggccaagtgcggtggctcacncctgtaatcccagcactttgggaggctgangcagatggatcacctgaggtcaggagtncaagaccancctggccaacatggtaaaaaccccatctctactaaaaatacaaaattagccgggcctggtggtaggtgcctgtaatcccangtactcgggaggctaangcagaattattgcttgnacctgggaggcagatgctgcagtgagttgagatggcaccattgcgctctagcctgggcagcagagagaccctgtctctcaaaaaaanaaaaaanaaaaaaaaanggncanaaaaagacagacagacatatatgtctttnncaatgctacgtcctaaaatgatggcatcacattaactggctttcttgcattactaaaaggatgaacttttaaaataattttgttatttaaaaaccttgtttatttttatttgttgagatggagtcctgctctgttcccgaggctggagtgcagtggtgcgatcttggctcaccacaacctccacctcccaggttgaagcaattttcctgcctcagcctcccgagtagctgggactacaggcacgcaccaccatgcccagctagtttttgtatttttagtagaggcggggtttcaccatgttggccaggctggtcttgaactcccgacgtcgtaatcctcctgcctcagcctaccaaagtgctgggattacagatgtgagccaccgtacccggccagaaacaactgttttttaatttttcttttgagacggagtctggctctgttgcccagactggagtgcaatagtgcgatctcggctcaccgcaacctccgcctcccaggttcaagcgattctctcctgcctgagcctcctgaggagcttgggactacaggcacacgccaccacgcccagctaatttttgtattcttagtagagacggggtttcaccatttaggccaggatggttttgatctcttgaccttgtgatcgcctcagcctcccaaagtgctgggattacaggcgtgagcccctacacccggccgaaacaactttttaagatagaatctatgttgttcaggctggattcaagttcctgggctcaagtgatcctcctacctcagcctcccaagcagctgggactataggcatgtaccacttcgtccagcttcncggctttttccatggttgtaaactgcctattcatgttcttggtggtaaatgtttcccaaggttgtttgtcttgaatttgtgagattgtctgatttgcagaagtttttgtttgagagtcttgctctgtcacccaggcagtacagtggcacgatcttggctcagtgcatcctccacctntggagctcaagggatcctcccacctcatcctcccgagtagttgggaccacaggtggcaccatcatgcccagttaatttttttctttttatgttacagcaatgagtctgggtactttttgcattttttaaatgttttttgtagagatgggttttgccatgttgcccaggttggtgacttacagaagnttttttttttttntntttttttttttttttttngagacggagtctcgctgtcgcccaggctggagggcagtggccggatctcagctcactgcaagctctgcctcctcggtttacaccattctcctgcctcagcctcccgagtagctgggactacaggtacccaccaccacacctagctaattttttgtatttttagtagagacggggtttcaccgtgttagccaggatgatctcgatctcctgaccttatgatctgcccgcctcggcctcccaaangtgccgggattactggcatgagccaccgcgccncggcctacagttttaaaaagtccttactgtcctgcaaagatagggactcttttacctaacaataccatgaacacacccaccaaaactgacaatgctttctgacatctaatagtctctgctcaattttccccaagtctcttcttgcaattgtgtccccacatcagaatctggacagaggccgtgctgtgcactgggatgcccactgcctctatttcctcttctgcgcttggtgccacccaggcgtccaggagccagtgtgttttgctgacaatgtcctgtgttctggatttgctgggctgaaccctccaggtgtcctgtgaaccctctcccatcctctgcacttcttaggcaggatgagcccagttcgagttttagaggcggtgctgggggcctcctgctgcttcacgtcattggacttgtcttctggtcctacctgtagtgaggtatggttggttctgggaagctgggctggtccacccattatcagtggcctcctcaactgtcatcttcaattttcactgtttctcacatgcatcattttattggacacttcaaagtggtgattttctaattttgggtgtgttttttttttttttttttgagagagtcttgctcttttgcccaggctggagtgcagtggcgcactctcggctcactgcaaccntccaccntcctngagttcaagtgattctcatgcctcggcctcccaaangtgctggagttacaggcatgagccaccgtgcctggcctgattttctaattatttctgtatttcttagctggaattatttcttttttttttaaaggacccncgtcatcaattgttgccccaaaattatagagttcatacagaaaagacaaattaaatgcccgattctttccttttatttgccaatttttatgagtcagtgccttacaacttccaaaggtaaacatgaggcttctttccttaagcatcatcatgaactcttagatgttcatttattcaacacaaactaaaaaaggaatgttaagtcttaagatatcattaatactaacttgcattacttgtttatgaaggattaatatactaaatagaatatatgctcacatttttatatgtagatattaatttacaagtaattaacatgctaaaacattttataattcgcttcaataacgtgtatagataacnacaaaaattaactctggcctaccttaggctacatgatcacagacaagctgatgtaattaaaatgagaagatttatttcttggtactttcatggctttatttttacattaaagtcttttatgatgtattatttattgctatcttccaccaaatgcttggccagtcaatcccagggtgatcttaataataacaactaatacatgtaaaccataaacatttatgaaaattatatatcctcatataaatttcataacatatgtaagttacaaaagaaagaaaaagtcaacgaggatatgggggaagccaaaaggaatacaaactaacaaatgaacctaactatgtacaaattatgcaaatcacataatttgcaggaggtggaaagaaagaaaagaactcatctaggcaacttttgaaaccagtacttagatgctacaggtcaaacacaaaaacaacagtacacgattaaggaagtaaggtgcctccatagtgactgcgcctccctggggcacaggttgaacagttcacctacagcactgacatggcctaagcgaatgtcctgtcaatctgagagccaggtttctccctgtcacaggaagaaactacacataagngaaaggggcaggtgagacaggaacagcaggaactagacagctacagaaaccaacagggcgggtaaatgcacaagcacgtgtcatagatccacttcccagctctgtcccaggagggcccagaagcaacaagcacagccagtgcccaggtcttggttgctaaatcccagtctccagtgagggagggctccctggagaagcagctgggtgcagagctgggacaaggaaaactgaagacatcccaaaataaacaagtgcttaaataaggatagggcacaggagacaatctccaggagctcccaatggccaaagcgtggaaacagtatcagattatgactcacagaatccaacaaacagcccttgcgttcatactgatatataaagaaagaaatcgtaggtcaggcgcagtggctcatgccttttgggaggccaaggcgggcggatcacttgagctcgaaaatttgagaccagcctgagcaacatgggtaaaccccatctctacaaaaaatacaaaaagtcagctgggcatggtggtgagcacctgtggttctggttactcaggaggctgagatgggagatcacgtgagcccgggnaggtcgaggctgcagtgagccgtgatcgagccactgcactgcagcctgagccgcagagcaagaccctgtctcaaaaaaaaaaaagggaaaaaagctgaagggactgctctttcttagagatgaattccaattaataaacgtcaaaggaatgaggaaaatgcaaaaatcacctttgaaaactaagttaataattactgcattgcaagacccaccagtggatgctgaaattaattagtgggtaggccgggcacggtggctcacgcctgtaatcctagcacctngggaggctgaggcaggtggactgcctgagctcaggagttgnagaccagcctgggcaacacggtgaaaccccgtctctactaaaaataaaaaaaattacctgggcatggtggcgcgtgcctgtaatcccagctacttgggaggctgagacgggggaattgcttgaacctgggaggcggaggttgcagtgagctgagatggcgccattgcactacagcctcggcaaaagtgagactccatctcaaaaaaaaaaaaaaaagtgggtaaaacttggaagtgaaacagacattcacttagtctggaagtatctccccaaggtatttatggatgacaaagggaaaacagtaactatgtaggggagaagccccggcagccgctgncaccacctgaactaacaggaccaggagttggacagactgacattgcatatctccactatgcattgagaagatgacatcccagctgtggtattcatgccaaaaaataaaataaaccagcagggcgtggtggctcaggcctgtaatcccagcacttttgggaggccaaggcggatggatcatgaggtcaggagttcaagaccagcctggccagcatggtgaaaccttgtctctaataaaaatacaataattagccgggtgtggtggcgggtgcctaaaatcccagctactcaggaggctgaggaaggagaatcgcttgaacctgggaggcagagattgcagtgagctgagatcacaccaccgcactccagcttagaagacagagaaagactccgtctcaaaaaaaaaaaaaaaaacnaaaaacaaaaccttgtccagtcataaggtcagagtccccagtgtgagggacattctacaaaatagctgagagtaccctttaaaagtgtcaaggtcataaaagacaaaagcttcnannaatcnnaatnnannnanannncttcnnaaaattcataaatagagaaataggctgacattaataggctatgttcggtgtggtggctcaggcctgtaattccaacactttgggagaccaaggcaggaggatccctggagcacaagagttcaagaccaacctgggcaacatagtgagaccccatctatacaaagttttaaaaatcagccaggcgcggtggtgggtgtctgtagtcccagctactaaggaggctgaggtgggagatcccttgatcccgggagttccaggatgcagtgagctgtgtttgcgccactgcactctagcctggacatcagagggagaccttgtctcaaaacacaatttttcaaaaatttangttttttaaaaaagatattgagatgctacaatgtccatttcaggaagaatatcatagcacttttgagacaagtttctttttttttttgagacacagtctcgctctgtcacccaggctggagtgcagtggtgcaatctnggctcactgcangctncgcctcctgggttcacgccattctcctgcctcagcctccccagtagctgggactacaggggcccgccaccacgcctggctaattttttgtatttatagtagagacggggtttcaccatgttagccaggatggtctcgatctcctgactttgtgatctgcctgcctcagcctctcaatgtgccgggattacaggcntgagccactgcgcccagcctgagacaagtttttctacaaaatgtaatgacattaaggtaatatgaagagacatgatcctcatctttatgtaactggagttcaggtattcattacgctcaacaatatcaaccttttatgatgctattttgttgaatgtgatgaatgccactgataataggacatttaattccatttagaatatctgtatttccaagtaaagtcctaaatctgccagggtggagatttatccatggtaaagtctattcaatccagatataaaaaagatagagattgagggccaggcgcggtggctcacacctgtaatcccagcactttgggaggccgaggtgggcggatcacaaggtcaggagatcaagaccagcnctggccaacatggtgagaccctgtctctactaaaaatacaaaaattagctgggcatggcggcacgtgcctgtaatcccagccacttgggaggctgaagcagaagaattgcttgaacggggacccgggaggcagaggctgttgtgagctgagattgcaccactgcantccagcctgggctacagagcgagantctgtctcaaaaaaaaaaaaaaaaaaaaaaaaaaagagagattaaagacatttaaaaaaaagattacaaagaagaaactgcaaagcaaaatcacaatgagatattacttcacacccagtaggatgactaaactaaaaaaggtaagtgttggtgagaatgtggagaaattggaaccctcatacattgctggtagaaatataaaatgctgcagctgctttggaaangtctggcagttcctcaaaaaattaaacagttacctcatgacccggcaattctactcgagaattgaaaagatgttaatataaaatgtatacaaaaatgttcacagcagcattattcttataaagccacggnagtggagacaacccaaatgtccatgaacagatggacaaaaaaaaaatatgcggtatatccatgtcagtagtcggccataaaaaggaacagtcttagacatggtacagcacagatgcaccttaaaaatgctggctggggacaggcgcagtggctcacacctgtaatcccagcactttgggaggctgaggcgggcagatcacgaggtcaggagatagagaccatcctggctaacaaggtggaaccccatctctactaaaaatacaaaaaactagnctgggcatggtggctgctgcctgtagtcccagctactcaggaggctgaggcaggagattggcaagaacccaggaggcggagcttgcagtgagccgagatcgcgccactgcactccatcctgggcaacagagcaagactctgcttcaaaaaaaaaaaaaaaaagaaaaagaaaaaaaaaataaccgggcaaggtggcaggtacctgtaatcccagctacttgggagactgaggcaggagaattgcttgaacccaggaggcggaggttgcagtgagccgagattgcgccatggcactccagcccaagtgacaagagtgaaactccatctcaaaaaaaaaaaaaaaagaaaataaaaaaacttgctgggcgtggtggcatgtgcctgtggtcccagctacttgggaggctgaggtgggaagattgcttgagcccaggagtttgcatttacagtaagctatgattgagctaccacactccagcctagagagcaagaccctgtctcttgaaaaaagaaacccggtcgggcgcggtggctcacgcctgtattcccagcactttgggaggccgaggggggcggatcacgaggtcaggagatcgagaccatcctggtgaccacggtgaaaccccgtctctactaaaaatacaaaaaattaagccgggcgtggtggcgggcgcctgtagtcccagctactcgggaggctgaggcaggagaatggcgtgaacctgnggaggcggagcttgcagtgagtggagattgcgccactgcactccagcctgtgtgacagaggaagactccgtctcaaaaaaacaaaaacaaaaaaaaccataggctgggcgcagtggctcatgcctgtaatcccagcactttgggaggcccagctgggcggatcatgaggtcaggagatcgagaccatcctggctaaccncggtgaaaccnccatctctactaaaaatacgaaaaactagctgggcatggtggcgggtgcctgtagtcccagctactcaggaggctgaggcaggagaatcgattcaacccgggaggcggaggttgcagtgaggtgaaatcatgccaccacacacgtctgggaaacaggaacgaaactccatctcaaaagaaaaaaacaaaaaacgaaaaaacaacctctaaaatgaaagactgtatccctagattgctgagaggtaaatgaaatgtatgtagaacatccagcagnaggtgcagcctcagacactggctgaccatttgtgcaacctgagagaggcgtgctcttgcagcttgagttccaaccatgccccacactccactcccnattaggctacactgcaacctatcacttgtatgtttcctatattagaccatcagttcactgcatgttaagaaccaaaagttaccatttacatgacaactctgnttgccaggtacagacatagccatctcatgagatctaaaaggatgtctgagagcaacactgtagccctttaacccacgtgaggctgaacaggattcaatcagctgcccagtgtagactgctccttagatctccgtgcacaccagccagaaaccagagcactgtgggagcgtgtgcacgctcacatccgagaccctctccagggacctcaggctgaagacggagctgggcagaccatgagccaccctggaagagctccaagtcccacaggaatgctgcctctcctgcccggggctggccagttcctactctcagcccatgccggccagggaaagggaccaggaagaacagggcttcccttttctccccaccctgagtgtaatttcgcttgtcgacacttaagtcatgtgtccaacctgggccaatccctgtgctttctttttttgccccgagatggagttgtgctctttttcacccangctggagtgcgatggcgcgatctcggctcactgcaacctccacctcctgggttcaagcgattctcctgcctcagcctccggagtagctgggattacaggtgcatggcaccatggaaccacaggacagccagaggcagagggggttccccanagtgcccatggggcacaggctgccagttcagtttgtcagccatagctcgctgtctgagcaaagcatcactcagtcaccatgtggggggcagcagggcactgggcagtgtggagtgtccgccctgcaaggccctgtgcccggaggactggcagcancccttcnagaggggaccagacagcccagctggccnaggcctcatgtctacttgctgtctgtgcagtcagtggaagagccctgctcttctttctctcacaagcaccctgctggaacaataaattaaatagtcctctggccttggaagtaaaataaggttttgtgttttatgaataaggaaatgaagattgggtatgatgaggctcagcccagctacctgacctgctgcccaccagaagccccgngtggcttccagacccagcctctatcctagttataaatggccagccccacctccaccacaggcacagaatcaggtcattctcctttgaccactcggcagcacctgcctcaatgaccccaccactggccccccagcaaataccagctgttgcttctatgacatcattctctctacttcctttacctccaaccctcccaagaccatgccacatatggacacgacttcgacgtgtccacgtgctatcagctgacaaactggagaggtccggctctaggcaacgctctcctgcgggccagctggtgcctctgcccagcctgtccaatgctgacgcccctcagctggctccttcctggggccttctctccagtgacacctacccacccagttccccaaggcctcatattacttcattcccatgcccctcactcccgagaatgccaggaagtcccaaatcctggtcattcctccctccaaatgcctgttacaccactactgcacaaccaaagcaatgctgcttgtcagtcctgtcatttgtcacaccctgcaggggctgaccacaccagtccatcaggtgccctctccacttcctaagcagcagggagccagtcctagcacggccccagagagcagaccccctgcctggcatgggcctgctcaggccttgctccaacaccgaggcccgggccaagggcacctgcttggggataacctgactctaactcactgcactggtgacattttctgtcacattcacagcgactacagctggggacttagtaatcctttctcctgctagactgggcttctggaagggccaagattagtcatcctgttcatctgggttcctagactgtggccctggctggcattgggcaagctgcttagatggcagctgctgatctgtagtgacatctgtgaccgacagcgaaagaaccaccncttagtcacactcccttgcccatgactcagccaggcccatcccagcgtggaagcaagcttagcctgggatgtgtgcccgcaggagccgctggtgcagggaaaggtttctgcagacacggcatgcattcctgtctgtctctccnactaccactgcccactgccctgggcttccttacatcccagctgtgggacagtggggtcaggcagaactctggagctcccttgtcccccttcccatctcattctcaaagtgctgtcaccaacccagcatcagggggcacaaggctctctctccactgcccagcttggagtgcagtggcatgataatggctcacagcagcctcaacctccagggctcaagcgatcctcccacctcagcnctttagaatagctgagaccacaggagcacgccaccacactcagctaacttttgtatttttagtagagatagggttttgccatgttgcctaggctggtctcgaacttctgggctcaagagatccttctgccctgacctcccaaagtgctgggattacaggtatcaggcgttgccctactcctttttgagacggagttcactcttgttgtccagactggagtgcaatggcacaatctcggctcactgcaacctccacctccctggttcaggcgattctccagcctcagcctcccaagtagctgggattacaggcatgcaccaccacacccagctaattttgtatttttagtagagacggggtttcgccatgtngnccaggctggtcttgaactcctgacctcaggtgatctgcctgccccagcctcccaaagtgctgggattacaggcgtgagccaccngcgcccnagcncgccccactcttaaatggacggattatcacagcttccaccagccacttcatcaaatatacaactaagagaggatcctncatgccttgctccgnggcaaggttaaaaacaacaacaaaaaaacaaacagaaaaaggaattacactacaaagtcaaaactgctgaatccacgtttctctgaaaaccagagtacaagaaggaaaggaacagcccagagatgttctggctgtgggaagcctgtggacggcacacagggcagccatcccaccnccaacctcccctcacctggaggcacaggcacaagggtcaacaggtggctcccgggcaaaggtgtcctcccacctggtgagttagagaggaaggtgttaggtgtgaggcaggaaagaagataagaaagaagacaggcagcttcggccctccaggagcggggaccccccgccacnccccacaacccatgccaacttcaggtgtccaacaccagatggggctgctccctccatccccaactcaggttctcccaccccctcccagctggacagacaccaaaatcctggcccaggcctggactccaacagtgggacgaatcaaacagttccagttctacacacatttctattttattatggaaaaggtggaaacgccacncttctccacaacagcaaccagtaaaatttatcccaaaaataactcggtacaaaacaggtctgtttcagaattaaaaaaaaaaaaaaagaaaaaaaaaaaacctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccatctgaancacagaggagaaagaggcttgcattcacaggcggcctgctccccactgcggctttgaccaggcccccagctggctcccccgggactcactctcgcattataggcgtccagctgggcatccagctcctctgccgaaagctgctgctttgaattncctgccggcacctctgcctcttccacgggcgcctccgcgggtgcctctccgggtgcctccaccaccaccaaaacctccagcgccacggtttctagtcatgccacctctgtttacgctagcaaggaagacgaaaccgttcacacacccggaaggaccctaagagcgacgcagcctcacccntcggccaatccccttccccagaggccccggaagtcacctctgtgcaggcctccgctgtgcgtcaatctgtgacgtgacaagctgaatgttcatggggcggcctgcggcaaagaatacgagaaggcacgttctattgagaggnctctgaaacccacccagctggcgccacaccctggtctccatgcaaacactggaaagggcctctgtgcgtctcaaatgcccccgacaagggaaatggcctggagatactggtgggagaacaaaatggcaaggaagcaaccccaccaacacctcctcactccttctcagtccagactaggtgggctgctcgctgaggtatcggggtgctcgtgggtggaganggtgtgggtgacctgacgaagaagaaccggtacctttgtctttacgactacagccccgcactcagaggtgtactatggcggttctgagaaggcttcacagaagtgaatcttccggaaggagctgaaggaggggagggatgtagcttgctggatgggggttcacanagaggttggtccagatgtgtggggcagcatgagaggtggcagatggaagagagagacaaaggggcaaatgcaaagtgtcctcagccacaggggtaccccatattcctacctggacaggtgccagccccaaactccacanagccccacagtcagcgtgggtccacccccagactcaccatccagagggacgccgttgtactgcttcatggncttcagggcatctgccttccgctcaaagtgcacgtctgctgttcctaagctgcgaccagagcgatcatagtgcacagccgccttcttcagcgttccaaattcagcaaagagttcctgggagttgcagagagcagttgtcagaaaagcaacaaaactgcgttccttctggtggcccagggacaggccctggaagcgtgagttgctttgggggtggttctctgggaggcaggacagtggttaacgggaaatgagggaagggcggggcaggagggacagcaacttccaagagcacctgggtctgagggctcctgccattgtggggacctgacacgtgtaccacgatgcaggtagaggaagctgcaaagcccactagcaacgggcacaaaattaagccactatcctcttcaacaaaggaaaatgtacaacacanccncaagggctgttccaagaaacggtaaaggccaaaatcaagagcaagggaagcagtccgatatcagaccagcttgaagggcctgtagattcgggagccctgaccccagcccctcccccaaaggcagattctggctcacctttccctctcctcctactcaagcctgcggcaaagtctgaagtcaagcgctgtcatggaaactgccctgacctcaggcaggctgggagttggagagggaacccagagtgtggggatactccggccngcaggcacacagcgggaactggagttcaccaaaagcggtttccagtnggatgctagaaaccaccttaaaaaanagtgttgagacactgtgagtgctcactggccctactctgtcctcccaaggcaaatggctgggctgtgggcaactgaaccctgcccnagccatctccaaaactgattcccaaaaagtcatttcttaaccagaaaacaagttgaaatgccattgggattcaatttttctttttttaaaaaagaaaagcttcaaccaaagatggatttgagagtcatgtcactgacgggacacggcggtggggagtgataaaaccacangcgtacaaggntctttataagacagtactcaaggcaaacagagccagaaaaacagactccctgtgcttcacaagatacataaagaagattctttttctcacattaacccactaagacaggcacaaaatttaaaaagcaactgggctgggtctaacagccaaaaaccactcacatttggtcagtctttgtccctgnttagaaactggaagccctggcaggggattttcactcacagaacccatcnttcagactaacagcagcagttcctcaggctcagctaggctcgcacctgcctgcgcactgaccccggctttactagcactgggtctgtcctgcagcccttcagagctgggagggctcccttcgctaaggcgggaaggggactcagggccacatccccaaaatcacgatccgtcctgtgcagggcgaacggctcaccgagaagccctcgtctcttacctgaatatcggcgtctgagactccaaaatccagattggacaccagcagtttcccacctgtctccacgccggcaccaccgccgaagccactgtcgaaaagatcgtgctgccacttgtcgggaagttgttttnggctgaaaaaaaaaccgcaacaagagcagatctgtgagtctcagtccagggctttcctgaccctcacggctactccggacccttcctcttcccggcctgagaggatccggccgaaacggggccgccagcgctccctccggcgctgcagctgccccagcccgaggccgcacggtcccaccgcggccgcacaacttcagttcccttagactaacttcccgccgcctgtgccgcgcccagcgtcccctcctctcctgccacgaggccccaacgtccggaacaaacaaagagctgggaagggtctcagcctccgggaccggaccccgaaagaacgacctcgctccngnccacnaccccctccgcgcccacacgcaccctccggacctccgggcggccgctccaccagccttatccacccgccggcccgggtctccgccgcgagcggccccggccccagccccggctggccccctcccactctccggngnggncggcctccgcactcacccngntgnagggcgccggtcggttcctnccgnctccgccggcnncgccncgggcgatggccggncggtnncngatgnnccngncnnctcgattcantngcncgnnggcntgcgccccaccnnngnggccncnctggnanccgnncngncnnnnnnnncnncnnnnncnncnnnnnnnnnnnnnnnnnnnnnnnnnnnnnnnnnngtcgtccagagacangtccattnngtcnnccatgncgggcgcgnantcnggcatcggctcgagcccgcgnntcagcacgccngcacgtcacntcnggcgcngcgtgaggcctnccggtgccacggcctcggagcggctgctgattggccgctggcggacggctgcgcncgcgggacggggtgaggcggggaggcgcgtgcncactggcgtgcgagactcggcgggcgctgttgagggagtcgggccgcgactgtggtcgtttttataccttcccgcgcggacgccggcgctgccaacggaagggcgggtagggcggtgcgtgattaggttggcgaaggtgcgagggcgcagggggtggggcggcggccgttggaggcggagcctacgcgcccctccctccccgcacgctccgcccgatcggccagggctgggggcgctgggggcgctacgggcgcggcgggtgcctgggagctgctgggagtccttgtttccgctcccgcccaggactgtgcgctcggctcgcggtggggtccggcgggcgcggcttcggcgggcggcagccgctgcagacgagctgcgggttggttttttggtctccacctgcagcccccccaagtctgcactgtcacattttgccagtcatatcctttacaagttttcttgcgggccgggcgcgggcctcacgncctgtantcccagcactttgggaggccgaggcnagaggttcgcttcagcccaggagtttgagaccagccggggnnacatcgtgagaccncnatctctaaaaaaaaanntgagctgggcatgntggtgcnctnctgnactancagctanntnnnngnccnagnngngnnnnntgcttgagcccaggaggtcgaggctgcagtgagnccgtggtggcaccactgcactccagcctgggcgacagagccagaccctgtctccaaaaaaaaattatttttgcaacttattaatgaaaaccnagtgtgccatttcattgattttttttttttttttttgaggcagtctcattctgtcgcccaggctggagtgcagtggggcgatctcggctcactgcancctctgcctcctgggttcaagcgagtctccagcggcagcctcccgagtagctgggactacaggcacgtgccaccatacctggctaatgtttgtatttttaatagagacagggtttcgccatgttggccagggtggtcttgaactcctgacctcagatgatccgnccgccttggcctcccaaagtgctgggnattnacaggcatgagccaccacacccagcccatttcatggattttaagttgttttgagatacttgcttttgtttttgttttttgagtcagggtctccctccgtcacccagagtggagtgcagtggtgtgatcttggctcactgcagcctcaaactcctgggctcgagctatcctcccacgtcagcctctcaggcagctggtgcacgccaccacagctggcttttttttttttttttgagacagtcccactatgttgcccaggctggagtgcagtggtgcgatctcggctcactgcaatctctgcctcccaggtccaagtgattcctgtggctcagcttcccgaatagagctgggagctggcgtgatctcagctcgctgcaacctccgcctcccaggttcaagtgattctcttgcctcaccctcccgagtagctgggattacagttgcccaccaccacacccggctaattttttgtatttttagtagagacagggtttcagtatgnttggnccaggctggtcttgaactcctgaccttgtgatctgcctgcctcagcctcccaaagtgctgggattacaggcgtgagccactacgcctggcctctaatttttgtttttttggtagagatggggtttcaccatgttggccaggttggtctcgaactcctgacctcaagtgatccaccctcctcggcctcccaaagtgctgggattacaagcatgagccaccacntgcggcnaattttnttgtattttttgtagagacggagtttnnnnatnnnnncnnnnnnnnnntgagatctttgaagatatcctcaacgtgaggtaaaaccaaactcctgantgtcctgtgctcccaaatgtgatctccttgtccgtaaggagctgagtcccttcccttggagagaagagtgtgccctttctntanatggctaaagaaacctcacagatagttcnnttttttccnttttttttttttttttntttggnagagactcagtctcactgtgttacacaggctggtctcaaactcctgagctcaggcgatcctcccgagttggcctcccagagtgctgggatcacaggtgtgagccacaaagcggattgctgctggggcttgctgttctcccgtagctcccctgcagccctgaccctctgggcccagagccctttacttgttatttgttttaatagaaacggggctcatagcagggcataggggttcacgcctgtaatcccagcactttgggaggccgcagtggcagatcgcttgaggccaggagttcaagaccagcctggcctancatggtgaaacctcgactactaaaaatacaaaaattagtcgggcgtggagtcacgtgcctatagcctcagctactcaggaggccgaagcacaagaaatgagctgagatcatgccactgcactacagcctgggtgacagagtgagactctgtctcaaaaaaaaaaaattaataaaaataaaagtaaaataaaatagaaacagggctcacgatgtttcccaggctgggttcggactcctgggccggtatgatcttcctgccttggccccctgagtagctgggactgcactgtggcaggcttatacctgtgttggtgcctaaacgttctagctctgcagactcaatttagccagtcgtcctgttccctccgccgcaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcctcccgggttcaaacggttctcctgcctcagccttccaagcagctgggattacaggcatgtgccaccatgctgggctaatttttttatttttagtagagacggggttttgccttgttggctaggctggccttgaactcctgacctcaggtgacctgcccgcttcagccttccaaagtgctgggattacaggtgtgagccactttgcctggcccacatttttattttcttttctttctttcttttctttttttttntttttttttttgaganggagtttcactcttgttgcccaggctggagtgcaatggcgcgatctcggctcactgcaacctccgcctcctgggctcaagcgattctcctgcctcagccttccaagtacctgggatcacaggcatgtgccactacacccggctaattttgtattttttagtagagacaggctttctccatgttaggctggtctcgaactgtcaacctcaggtgatccacccgcctcagcctcccaaagggatgggattacaggcgcgaaccaccgtgccccccccaacattttcattttcatctcatgaagaaaagttgatagaaaaaaagccaggtggttggtacccatngtttatataaagatcctgtcacagactccataggatgaaactcagctgtgaaatacgtgggattaaaaagagattanagtctgggcgggcagatcacaaggtcaagagatggaggccggcatggcggcccacgcctgttattccagcactgtgggaggccgaggcgggcggatcacaaggtcaagagatggaggccggcacggtggctcacacctgtcatcctagcactgtgggaggccaaggtaggcagatcacagggtcaagagatcaaggcagggtgtggtggcccacacttgtcatcccagcactgtgggaggctgaagtggatggatctcaaggtcaggagattgagaccatcctggccaacatagtgaaacgccatctntactaaaaatacaaaaattagctgggtgtgtggcgtgtgcctgtaatcccagctactggggaggctgangcaggagaatctcttgagcctgggagacgggggttgcagtgagccaagagcaagactccntctcaaaaaacaaacaaaaaaaagattagtttaaactttttatttgaaaattctcaaaattgaatggcataggccaggcgcagtggctcacacctgtaatcccaccactttgggaggccaaggcaggcggattgcttcaggccaggtgttcgagaccagcctggccaacatggcaaaaccccgactctactaaaaatccaaaaaaattagccgggcatggtggcaggtgcctgtaatcccagcactttgggaggccgaggtggatggatcacctgaggtcaggagtttgagaccagcctggccaacatggtaaaatcccgtctctactaaaaatacaaaaaagtagccgggcatggtggtgcatgcctgtaatcccagctactcaggaggctgaggcaaaagaatcgcttgaacctgggaggcagatgttgtggtgagccaagatcgcaccattgcactccagcctgggcaacaagagtgaaactccatctcaaaaaaaaagaaaaaaagtggaaatgtttgattatgtttaggttgaaagcagagttttgcatcagcgaaatggtttttcatgagaccgaaatgagcgtaaagcagaagcaagggtcaaggttttgcccagggaggacaagaagaactccccagaggacagtggggaatggagaggacagtggggaatggggaggaccgagaagctactcactaccccaagtaaccaggcgtatttttgtagggccaggtgcatgcccatattgattgacagggtctcactgtgttgcccaagctggacgtgaactccntgggctccagccatcctactgtctcagcctcccaagntagcataccaccacactcatctgcctcctttgcttttttttttttttttttttttttttttttttganananagtcttgccctgttgctcanactggagtgcaatggcaccatctcagctcaccgcaacccccacccttntgagttcaaaggattctccggcctcagcctcccaagtagctgggattacaggcatgcaccaccacagccagctaatttgntgnatttttatttttatttatttatttattttcgagacagagtctcactctgtcaccagggctggagtgcagtggcacgatcttggctcactgcaacttccgcctccctagttcaagtgattctccntgcctcagctttccgaatagctgggactacaggcgctcgccgccatgcccagctaatttttgtagttttaacagaaatggggtttcaccatgttggccaggatggtctcgatctcttgacctcgtgatccgcccacctcagcctcccaaagtgctgggattacaggcatgagccactgcgcccagcccttgttgtatttttagcagagacagggtttcaccatgttggccgggctggtcttaaaactcctgacctcaggtgatccgtccacctcggcctcccaaangntnaccaggattacaggtgtgagccactgcacccngcccctngtctttgcttcttaaggtgaaattgagatgactgaatcttagtacaattttttttttttgagacagggtcttgctgtcacccaggcggcagtgcagtgtggcaaaatcatagctcactgtagccttcaattncctcagctcaagtgatcctcccacctccancctctcaagtagctgggaccacaggcatgctccacaatgcctggctaattttttatttttttattttttgtagagacagggttttgctatgttgccaaggcntagtcttgaactcctgggctcaagggatctgcctgccttggcataccaaagtgctgggattacagacgtgagccaccatgcctgaacaaaactacataaatttttaattttttttgtggaaatggagtctcactatgtttcccaggctggtctcaaactcttggctctgtcctgccacagcctcccaaagtgctgggattataggtgtggcgcctggcccgtacaaatactttttattctaggcttaacnttttacattggccctagctaaatagaaatctcatcactcaggaattaatcctcatttaatcaaacngggtagnggtgtaatcttaggaaattattgattgactctacnctgattggatttgtagttaatagctaattagngttaataactaaattcacaaggcacagttttatttgatctcttttaaattgctcttaaggatgtaacaaagagtgcgtgggatgccctgagggcaggcattcgacttctggagcagcagcttaacttctgaaattcctccngaaccatgtgtccacacctcgtctggctgcatccgtgggccagatgtgggtggtgaatcctgtggattagaggtggtgctaggtagcccccaagtgactgcagtggtgggtccacaggcagcctgcagagcccgccctgcagcatgccagctgggcctgtgatggggcatccagagggtgttgccctgaacactcagcatgtctccgctgacacagtgtgctcaggctttgttaacatggggcctgttggctgcagagactcaggagttgagagtctaatttttggacctgctgatggttaagtcatagtgagtcagtgttaacgcgcaaagcgtttgacgagtccaatgntgcttccatactaagcagcaccaggtttcttttgctaaaattgaactcctgtgaaaaattcagagtgactaagttcattcaacaaagaccgtgggagcccgaggctggtaaacaatgagtccatcccgcatcccaggggactctggtggcagtgcagttttgccgagaggagttttaatttaaaaaaatgcaatcaggagaccagcaggtcctggaatgagtcaccctcagtgcatctgcggactcatcagacaccccaggccggcttcgggtggggaatgcactagaacgaagtgacacctttgactaaacngaggcctcccccgagtactcagagtggcccagacccctctcctcagggggctagcaggcttcagctctcatttgaaagggccgatatcaagcagagttgtgctgaggccagaaacccccacgggcaggtcctcccagggnctgggagtgggcatgccgtggggccggcgctgccaggacaggagggtggccacgagctccagctccnacaatgccaggccgaccctgccgtnggggctggggctgggacttgctgtgctctgttggcagncagctgttcctcagggngtttccaggctcttggagatcagggacactcatttnctcttgatcatggctgatacaagcatccctctctgtgtcaggtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctagngtccccagaccccacccctccntgcccttgatcnaagagaccagttcactactcagatgcacgtctccttggtgccttgaccattcatgtgacctttttggcatcacagatcaagtgtctgcagatgggcccagggcctgtaggtcagacattgnccnctttttccccagcctcaagcacaggggacacagggtgggctaggccagagcgccacctcctcagagaggcccctgggctccccactgagcatgatgagcctgggtgaggggaggcgcctgctgcggttgccccgggtggaggccgcatgtccggtgtccncttggtcattgctggntcttcgcctgggggcgggctggtcaggagaccgattgggtaacactcctgatttcggcttctctgaaacatgagaggctgcagtgctggagccactgcccagggtccctacctgcacccctgcctggcttgtcacatgctcntgtgtccagcctggtcatgcctgtccttttccccacctcccctccgntaggcaaggtgcccggcgacgactgcccgctggtgtggggccagtgctcccactgcttccacatgcattgcatcctcaagtggctgcacgcacagcaggtgcagcagcactgccccatgtgccgccaggaatggnaagnttcaaggagtgaggcccgacctggctctcgctggaggggcatcctgagactccttcctcatgctggcgccgatggnctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcnggtgtgttttgatatgaaaactctcnatgaataaacatctccgtgaaacgccaaggnccctcgtcaaaccctgagtcatgactgggaggagnaaggagcaggatcagacggtagagcctggggcatgctcttcaggcatgctcttgcctgctggattgccggcggcggccctgggaccctccctcaggctggctctgagggaccctggctgtgcaaagctggcggccactgcttgtggcgcctccagactgaaggccaccatctctgagtgggcgtccattgttctcactgggactgtctgcagcggggctgggcctcccacagtgtagggatcagtgtcctgacactgggaagtgtgtccacacgtctgaggcttcccttcctagggaaaggtggcccntgggaggctcctttgtgtgcctctgctccccnacaatcgtggtgggaaggggccgctgggggagtggcagccccggcatctcaggctgcttctggacagagcacaggctgtgtctccagtaacctagggagcccttggcattcatggggccagtgacccgtgcccagtgtctcttgacccttcctcacagcaacctgaggagtagaccaggcctcacctgaaatctgtgtcagggttctctagagagacaggactctatatgaagagtatatatgaagagtttattngggagtattgactcacgtgatcacaaggtgaagtcccacaataangccatgtgcaaggtgaggagcaaggaagccagtctgagtcccaaaacaaaagtagagaagccgatagtgcagccttcatcctgtggccaaaggctgcagagcccctggcaagccactggtgtaggtccgagagtccaaaagctgaagaacctggaggccgacgtgcgagggcgggaagcatccagcatgggagaaagatggaggccagattcagccagtctagtctttccacgttcctctgcctgcttgtatcctggctgtgctggcagccgattaggtggtgcccacctggattgagggtgggtctgcctctcccagcccactgactcaaatgggaatctcctctggcaacaccctcacagacacacccagtgacaatactttgcatccttcaatccagtcaagctgacactcagcattcaccatcacacctgggaagcatggaacccagaaacaagtgccagggctccagtgccagtgcctgtcctgggaagatacccaagagaagacatgaccaggaccttgggggagcatgaaatggtgagggcacagtgagcttgaaggctgatgtcacctgccaggagagcggctggcagtcctgcctggtgccccccaaggggcagagctggcagagaggggcctccaatcgaaggccaggagtcgtggagctccagtgccttggtgtggctggccttcttgcccccctcccagaggaccccgccagtaacagccctgctggtggaaccttccccagtgggcatgaaagaaatgagggccccacaagccacatggactctgatgcctggagccaagaataccccttagggtggtagaaaccgcccccggggcactgtgcagtgtggctggctctccagcatcaggagtactggggattgcctgggggacgactcctagggctgggcgcccgtgggccctcccctgctgccactgcggcccacgcaagccgggcctgaagggcgcgagcggcatgggntggggagcttgagggggcgttgggctcccaccaagcgccagatccttgcgcgcctccagcgctcgcccgcgcggctggttcctttgggatgcggaggtgcgacggctcctccgcgcgcgcccgctgcaccccagcccgcccgccgcccctcccggccctccgcagcctcggcccgccctcgccgcagatataaggcggcccaggcggtggctgctccgagcccggacgccgccgcccaccagtcagccggcgtccccatggcccggtccgcgacactggcggccgccgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgtgagtccggcgtgccggggactgatggggggcggcggcaggacgtgggtngggggtgcggcggcccctcagcctttgcttgcctgccccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccnccaccgtcccactcggtgaccccaggcccctccggcgcgggatggcgccccaggtctcccctactccgctcaccccgcagttaatggcaaacgaataaataaatgaggcggcctcggagtgaggggtgctggaggactggcagccaggccacgaggggaacgggacctggaaatccccaagcctgggtatgagaaggcagccgagtgtgcggcggcagggcaaggttggcctgggccgcccagaggtcttcagacccaggggcgaagctggccacgacnccagccccgcggtgaagccgcgcctagccttggtgctccctgggggaagtgcagggccacggctggcccggttcccagtgtcctcccccagcccttcgctccccaactcgagagccaaatctgtgagggcatgggctggagcccctggctgccttcctcttgcccccatcccttctggccaggccaagtccgagggtgcaggggcaaggaggagagttgggggcctgagccctggctccagaggcccagagcatgcctccccagagctgaaggtgggagatgggtaggttctccctccgccgttgggtgtgactccggaactggcttgggctctggcctccaatgctgctacggggccaggcccacctccgggcccaggcagcagcactgcagggcctttctaccctccccaagcctggggcccaggcagcccctgtccagcaccaatctgtctatggggaactggctggtccctctgctcaggggaccccgcagtccagggttctgagtgggagcattggcaccaccccactcctgaaagcgggggcctggcaggatgaggatggcctgtgccccccacaccttggcccctggctcggagagcagggtgacaggctgccttcctgggctgtggagagcctcgcgtgcacctcgcctccagctcctgtgctgggtcgtgaggtcgacctcacaacagcagaggacaggcccatggggtgccacatgggccaggtgctgtagggcagaggccattctggagaggaatgtggggctgaaaaaagtactgatcataagcctcattttgaatgcggcgagaccaggcaatctatggcctccctagacacctcccnggaggctgcagtaagaacctcttcggcctctgggctgctccaggcgggccgtgacaggggtgtgggagacagagatcccatggcccctggaggggccaaggggcaaggagcctcagctctggctctcctccttattctagcatcgcctgctacagggggtggccccaggctttggagggctggaggcctgggtttcactcactgccaggctgcccgctgcactcccggctgctgggtgcatggtgggggcagggccaagagggtctccttgctgagtggttccctnggtccttcccagcagggctgggagccccgcgcagcactgccaccaggctttattcggttgtaccaaagagatttccgtcagccatgtacaaacagaacagagtccataaggagagtggcgaagctgccgggaaggaaggcaagcgtgttttcctggagccaggcgctgggtggcaggacaccgtgttggggggtgcccagtgggaggntggtgtggtctacacccagagaactaaaggggtgaccgcagtcactgctccctaaagccctctgctctgcacctcccgccacagctgggtgggcagtcagtgtggcctctgtccaggtggtgggggcatccggggaccaggtgggggcgcacgcnaggagcggtgcgtttcaggctgcaggtgccgtctgcccgtctcacttccggncctctccactgtgctggacaccctctctgagcagctttgctggaaagagcggagagcctgctgcaaaccaggcaccttgtaggcaggcaaggaggcagagtcctcaccagcccttccagagccaggccagttagagagggcggccctgcagagtcctatgtccaaacgcagaaggcgcagaagcagagcagggggagggccggccagggcctctgccaggttagaagtcaccatcgcngctcccccaggggctgtgccgcctgctgcctggcagcctccaggaaggccagctccttggcttccttcttctggtttcgcgcctcatactccaacctgagagggcagggtaagtctagcagagagcgcccatgaggcggctccgagggggagggcacggtaagtctagcggagagcgcccatgaggcggctccgaggtgcccccnacccaactgcaccntgttggtgatgatccgctggacgatgaggtctgtggtgaggttgctgccactgtcaatctgacggaagatgccccttctcttgggctcctgggggtccagagaggaggagcgggatgaaggtccctgctgacctccccaagacccatctgatgccctgccccagagggagaccagcgcccagggtcccatgggagtggtgcagtcggagcagctgcgccaccatgcccgtttcccaggcaggcacagtgagtcattaaatggctgggaggtgccaatggcaacccctgtgcccagcaagggccagcatgacccacctggtatgggtcggagccatccctgtcangggnataatttctgtcttgccgtgacacaccaggtccacctggagnaaggagtggggtcaggagccctccccggggaggcagcggccgtcgccacccacagcccagcacaggccccgggggnttngggagagctgaccctgccctttcctcagcccaggtacctcctgggnccccgcctaggagcccacagccagcctgcattcccagcccatgcaggaancagaggtgaacagagggaacgaggtgagcccatgcggagcctcaccttgaagtgacttaggagctctgctgtgaccgcgtacggggctccaatcaccacttctgacacgtactgtggggacagtgggggcagaaagacttgctcggtccctgctactggtaagccagggccacagggtggtgagagacggctcagacatggggcggggctgccagtgagtagcagggatgggctgggcaggctggggacccctnggggctcctccatgagacaagaaggaacagcatctggagacctgaccacccctcctcatgcctcaacaaacaggtatgggcaggtgccacagaactcggggtgctgggtgcagctctgccagtgacccaagcccccctgccctggctcagggaggcccttagtaggggggantgttgntnggngaatgtctccccatccttgggctggctcctggcccccactcacccggcaggccagcacgctcagagtccgttcatgcagattcatgatggggtagttcttccccnttgtagtgattgacctcctgcggccagagtgcggctagctcagcccggagactttttggggggacagggtgtgcccctcccggnctgtccctcatgggaagaagtcggggaggttgctcgcccttgtggggatgccccagacaggacagccctggaccccagaagcctacngatcaccccccagggtctcctgtgacttcaccntggggccccttcccagagaccacctgcacctaacagcaacgcttagggcccctcgagggcccatcagctgcccaggggcccagggagcaagaaggcagtgacctggtcaaagtgtaagcccgcgatgatgtagggcctctctgccagcctgtgcaccttctccanggaagtccacatgcccgatgtctgcacccaggttaagaagcagtcgggatggggatgacagggagcagctccctgacagctcatgcccaagggcctccccgccatcctccctgctgacagctgctcccctgcaaaccagccagcccagtctgggggccccaaggagtcaagtgaggcccccgggtcccaccccatgtggcacatgtaggggagcagcagaggcccagaggatacggaacaggtcgaaggcaccagccacatagatgactgtctcccctggctggggctccttcccagnaagcaaactggatgatcttctgagatgtctgcaggaactgggataccccggtccaggggttccgcccaccagggcactgcaagccaagagagggagcaggttggcgggggaggcctcccaggtgctgccctcaccaggtcaccaaaccctcagctgtcacctgccagcaatcccatttccagccagtcatctcgggcaggggacacactgccaggccaggtggcaggtgggactgtggcgccaccccacaaccacagcaggcaccgcagcagacaccacttcagcccagcaagcgaccaccaggaggaggcaaggagccctgtggcaggtgcacacagcccttgggagggacctggtaccctgagaccactgtctggtcacctgggagcagccttctgaggaaagtatgtccccggcgggtatcgggtgagggggctacaatgggagagagggccaggccacttggttagaggccacctgntccacaggcaaatccttgctcctccaagcagtggctgccgtgaccggccagccggtgccaccacccgcctgccctccctcccagcatccaccagtgagccaaacctggcagtcagtgcctggtcagtgccagggacagagggaggagggtgaggctctgggctggcctttccccaagggatggctgggacaggtggccgggggagccccctgcagctgcgtgctcagctctccctgcacagccgcactcaccttgccaaaactgtctgcatactcccggtactcangaggacatctcctgcacagaaggtcagagcagggctgaggggcctgccctcccggcgtggccaccccagaaccggctggggatggggagcagtgggcaggaggaccctgagagggcagggaggtgcccctcctttcccctggagacctcgacccaggggcctcggggattccgccgccgactcacctggctgctgtgatgggctttggttaccagcagcatgcggcccacgaggtctgtggtggacaccccttgcgtgcgcttgcattctctgggggacacagtgggagtggggtctcatcctgggacactcgcaaggctctgcctcctgctaccaccanctagggacactagcagccctgctgtggcagnaacccacggctgccccaaagactgagggtccccttcctgtgcaaggccataacagaaaacctgggttgggaacantggggaaggcctccancgcttttattgactgaagggagtggcaggagcacagaaaaggacccttgctggggcccaggtgtgcaatgccagggagaggatgggcactggggtagcagctctgcttcctgcctccctcacacccacgtcctgcccgctgagcatctgcagctgagtgaattctcagctgcagcatctcatgcgggagccactggcctcatgtccctgacgtctggtaattcagatatagtgccagctccccagcagtgccagccacgtcccccgagctcaacagctgccacctcacaaagctgtgcctttggagccctnggggccatgggtctgcagcaccaaatggcaagggcctccaggccaccccacaatggcacctccatccctcgagttcccagtcctgggcngtgaggaacatggcccagggcctggacgctcccctcacgggctcccggtaaatagcaaagcacgagccaggagggagccccgtgtccagctccctggatggccaggcccgcnggtggagactcacctgtacctcccagcctgctttacttcctcataggtgtcccggccatctacagtcagggtgatgtcatctaagcagtgacacacaaggacaanggatccttaacccaaagccaccagaaccttcagagcccaggaccctctcggcccctggcctgccctagtgtccgcgtgcccatttctaggtgggggcccggaaatgtctcagatcctcaaagggcggaggccccctgttcccggatgtcccaccagcagatctgatcctgagccacctgatgtccccaggcccccaggtcccagccccgccactcactgccgtgaacacagaagtcacagttgtatttgtccagggtctctagtgtagtgacgtagggagccgctggcaccacctcgtccacccatttgatggcctgcaccatcttgtatctctcctcctgagtgaacaccgggggccccttgtgcttggcgatctcctctaggaaaaggacaacggggagactggggaccccagcccacccggcccctccagtaggaggccccttcccagcacccagctgtagccacacaagagggccggtgggggcaggctgtctctctaccctggcccttagcccactagtgctggccaactgggtggctctcttccctgcgagggtctcaggcaaaggcagagattccttctgacgagcaggtgctcagcccctgaaggcttgggagcctcgctggcagtggtggggagcnaggtgccccttctctttagctgggacaggaaantgcaagatgggaaaggcattaggccatcctcagctggggctgggctgggtgagcctacagtgccctcccctacagctgtgccctggcaaggtggccccaggcctgcaggctttcagtcaacagtcgcaacccacaggagggctggggggccgcgggtgggcgaggccatctgtgcttaccatcggtgtgcacgcctacgatgaggtagtcacccatggcccgtgcctggcgcagctggttggagtggccgtaatgcaccatgtcatagctgtggagacagagagagtgggtggtccctgtgccaagggtggggaccaggtgtccctgtgggttaggggcagagctttgctcctctgaggactccttaggaagcgctctgagaagctgctgctgggagccctgggactgnggnattcggaggatgtaggtgctcagctctccacccncnactggctcctgggcctgacggntgggacccctgtgccagatctagaaagggtggcaggggcagagatgtcaaggcctggctgggtctagaggactggtgggtgcaggacagactggagcccactgaaagctgcagggccacgtgtcctatcccctcaccaaatatcaactgccctgggcagtcactttaaaataagccgatgttaactcttggggtagggttggatcctagactaccttgagacaagcaaacagtccctggggctaacccaaaacaaatccaaccacaaaataaaaccctgggaatcactggccctgaaaatcctgtctctcctcccttacnggcctcaagctcagcaggcttaacgctaagggtgaacagccactgccttgccacctggctcgagagttttcattcacaaatctaggtctgctaacacgtgaactctcaagcccaaagctacacagccctgccaccaactgggcctcgctgccctggcttcttcgccacttctttacagcagcggcccatcccctcaagtggacaaagctgtccctgcctctccagggagaggtgtgaccctggcagcccacacagtgcacagagttgctccactgcacaccactgcttcctcccagcacccctgccacagtgcgcggangcccggcagacatgctgggtaaaatctggcgggcccatgtacccactggacaggctggaggggaggagggggcagaggctgggccaggggagcacagtctggaatggggctggggcctggtcagggcaaggntcaaagtccactgacacaaagccacattccttttcccagaggtgactcggacacagaagacaaggccctgcttgctctcctgggaagggctaatcagatagaggcgcttgcnttcctggattccatccggcaggcacgtgaaagggtcagaggtagcaaattatcagtaacggtcgtcttcctttcacttgttgacaacccngaaacttttcttaaaacaatgccctctgactggccagggaagaccgatcgcattctagccccgcggaggaggacccgggagcccgcgggcttcaccgcgggtcccggacaggcaggtcgcacccgatgcccacctacagggacgctcgcccggaggccaggggaacccctggaccggagccgggcaagctggttgctggtggttacggagaagcagggaggccgtggctccagatctcagcgcggtggctgcaccggagaggtcggcgtgaccgggcggggcctccgccagaggtagacggggtcgcccacggcagggcgcggagcctctgcagcccgaccctcccggcaggcgagccccgcagcctgccagccccggcccatgccggacgaggacgccacccagaacgcgggcccggtccccgggcancggctggcgcggcgccccggaaggaanncggccccggcgcccccgcggcccgccccggccccgcgctcaccagccatcgcaccacaccctcacggcgcgcctgccccccnggcccggctgctctgcgccgnctgcagccccgcgcccgttccggatcatggccccgcancggcggcgcggacagcctggcagctcccggcgantccgagcgccgccgnccgccccgccaggngcacgctcagcggccgtcacgcgggcctcacccgctgcgcacggccaatggcgtgcgcngntcggcccgagccccgcccccnccncccncnnnccgncnccnnnnnnnnnnnnngngncncnnnnnncnnnnncngcnncnnnncgcnnnnncgnnnncggnnnnnnncnngnncncnnnnnannnncncnnnnnnnnnnnnnncncnnncnatggcgtgtgccgcgctttccgagccncgccccccgacccacacctggcctctncgcaccgcccacanntggcgctcggctggcgnggcagtgcggcgtggggaccgtcccaccgccgccacctccgggaacctccacggggcgctgtcccaaccaggggagttttttttcttattttttggcacaataatctacagttgtcccctgtccaaccaagggagttttaagccacgaccgagctgccaggcggcagacctgagcccggggagcccgcgccgaccactcggggacaccggaagccagtgcagaaacngtttaatagaaataaaaaggtctgcatagagccgaggctcggagccacccctctgccgcacatccagtacagagaggattctataaagttcacactttttcattaagtagtagtagaaatacggtgaggccctgagactggcctggtgagcgaggaaaggccgctgggcgcttccactctgcaggccggggctgaaataacccgagttccgttctcacagaaaggtgcggctgccacctcttgacacagaggccggatgggcaggtgtcctcgatggccaggccgtatcagggtacaaccgcagcagtgcaaggggcttcctcaaggacaaatggctaaaaatgtcacggtgaaaatgtcatccccaaagagttcgttctccctagacccgtgggggcaacccagccttcaccgtgacactggccatctgcaaagtgccaactgttcttcatcgagcacgtgattacgtcactttcttcctttttgtgcgttttgtgcagcccctgccaaaccagccccctaggatgggggccgagctaagcggtgcaccccggtccccaggcggggcctcctctctgcttctgcacagcgacttccgactgtggctgccttcnttncancagcacgcaggggagtcgccagtgagaaaatgggatcctgccacctgccaaaaagggaaagcggcatcaggcgggcctgggagcctctcgcagtcacacctgccccagctcgggaaagctgtctgcggtccctgccttcccatccccttccctcccgtgtcaactgcggcggggctctggttggcggcagcttcattgttaccaagctgcagaacggatgtgggagaggtcacctcttaggtggtgactcaaaggtcggcacccacactagctcggtctcctcaaaactccgtgtccttgtccaccactgagcggcgtgcacacacagggtggggcagcagtggccccagggctgcctccgtctccagggatgagtcactagcaactctgggccccaccttccacttgtaccgctggggcaggtggaccagaccctctcccccttcccagctgactagggaggcgtggcctacagacgaccccgtgaagaaagcatgtgtctgacggagatgcagaaccacagatcataacttaagatacagatacgcactgataaggaaaatgagctaagttaatgtaaaaaaaaaatacagtacacgatagcccacatcacagaacaccacacacataacatacaagaagtgccaggcccagaaggtgaagggatccttaatttcttgaaccctttgattaaaagaagttattgatttcccctataagaccctgaaaattcacagagaaagagagtgtaaactttttactcaatacatacaccaagtctaaattatcacaaattctgtattaaggcacagtttgtttaagctttcccaaagtacgccaactcccaaaaccaagcacacagattctgtctgaccagagctgccgagtgctcgtcccctccagatgcttcccaccaggcatctcggagagctccacggggaggcctggagcaggagcacgcgggcagaatccctctccccgcggggnanttgtgtgtgccacatcagccagggcaggagtggcacacgcagggntctccgccaaccaccgaggtcaggccctctggagaccaccacngcttcagtcatgcctcaggcaccactgcaaacacctcagagcttcctccacactcagnctcacgagagaagacagacaaggcccagcacacagaggtgcggggaagcaggctgctgcagcggctcactcacctgctataggcggggatctccaagcccagnctcggccatgaggagccgcatgacgtcatcacacttcccatgtagcttcagggcagcccagtcatccttcggggtccactgaggacagggaaagccgagtgagagtaacagcagcccaacccttcccggtggcctgtcagccttggcccctacgggctcagtcggtgctccctgagcacccacgggggccctatcagaccgccctggtgcatgggtgtggggtgtctctggctgtgcgttctaagacccagatctaaggacgtggctctcagcacccgagttacctgcaggttcacgatgtaaagcttcggccgccggnctagggggcttggtcatgcaccagaggcgtgggtacttctttagaancnctgtggaagcagacagacagacaccgcacacacacaagggacaagtctgtacagtgctgggccgcagagctggacaccctcgggcaggcaggngctcggttcactcattgtgtcatcggcacgtaccttcaggctggaccctagacacaggatggtgtctgctctgctggcagcctcggtcgccgcnttcccagttcaaaggctgccccaacgtccccctctccccaaagtgcacaatggtgtcccgcagctgggtcccacacttgtggcaggtccggcctgtctggtgtctgtggagggcagtgcgctccgtcacatcgaacacccgcacgtactccctgttgggaacgcaggaggtacagacctagaggcaagagggcacagtgagtgggacccgcctgcccatggagaccctgggtccctgcaggactgctcacttcaatgtacatgttcccgtggagctcggagatggccgtgcgcggcagcccactcctcaggtggagcccgtcacagttctgagacaccacatgctgcacctggaaggcagaacgggtggcaaggggagggatggctgccagtggtggtggggaggtcagtacccggccacagcgaggctgttctgagccccgccgatggctcccaaaaccaggggcagctccgtccccccagagagccttagaaagtaaaacacacaacaggtccaaccaccaggagtcaagagggcctgtggtggggagngggctgtccttcctccagccctgatgcacctggagtggctgggagggcaagaggttgcaccgtcccggcaaggttgggaagtggctcggggtttggcaagggccactctgccccagatccatgctctcttgggtcatgacatttcaggtccctggggacctaggcagatcaaccactacaccccattggttgagggtgttcagcagaaggtccccagagatgtcctataagcctcccctgtgactaggatggcttctgaggtccacagaaaaatgcaagggaatcacaaaggggaaaggccaccagcagctctgaggctgaggctggctgcggatgggatggttcagagggggagctccccttctgtcctggagagtcaagcacaggaggatcaaacccgcggcctaacccgcttggtgggtgctcatcatgggagtcaactggcagacagagggcgggtgcagttagttgcccactgggcaccaaggtgctctgcctggtcccntggcaagtgtaccagccacccagggctcttaccagcttctgctcatgcagacgggtgatgctcatgtgggtgagggnttggctcggcctcgctcaggtcggcagcactgccaggcagaaaggaaggcaaggtgaggagagctggagctcaggcccgtgctgccgctgcccagcctatgtgggaggccatgcctggcccgcttacctaacgcttctccctttctgaagcagtgtccacactccattagggccccggtagtctgggatagacgctgcctgcatgtcgagaaaaaaggtaagccaagtcaaaaggcaccactgtaggtactggcagaattcccagaaacggaaagccactgtcactcctgccgcattccgggctggcctgcatgttggcctctattcattccacagngctgacctgcctgagcccatatggagtgtaccccaattcggctcctcccttctacctggacttccgtttcccgcctggcctggctcatccttccaggctgcacgcagccctgcctgcctccggaagcctctctggcaccgagcacaaagctgggctctgtggcacatgtgtcctccacactgcaggggaagactagtcatgttcctaaagtgcccccagggccgagcccacagctcacacatttagcaaatggtgaatccctaggtgggtccaggcgactgtccattctcatgtcccagtgctgactattcccgctccaccttaacaaaggcagaacaacttcttcagatgagatgagcatctaacttcccaggttttcaatcctgtgaaacaaactgaggcccacagagggcacacaagatatgccaggatcaaggtgtcttgtgttcccttttggggactcccgactcctgcttaaactcagaaaaatgcaccacccccccnggacagtagttccgacagtcacattcaagacgggnaaccntcaancactccgatgaaatccactagctgcatgtgcttttagttgccattggaagttccnatancaggtcacgtgactgttacataattacatgactggacttttttttttttttttttttttgagagacggagtttagctctttcgcccaggctggaatgcagtggcatgatctcggctcactgcaacctccgccttccagtttcaagtgattctcctgcctcagcctctcgagtagctgggattgcaggtgcccgccaccatgcccgactaatttttgtatttttagtagagacagggtttcaccgtgttggccanggttgttcttgaactactgacctcatgatccgcccacctcggcctcccaaagtgctaggattataggcatgagccaccgcgcccagcatgactggacttttacatgtgacttgtggagggaggagactaaaccccagggctccgggtatttgagtcagtagtgaactccctttttgcattcttgctgctgagcctctgctgttctttgcttggagtgcctcattccaaccttctgtaaatctcacccatccttcaaggcccaatcaaggccacctcccacaaaaagccaacgcaggtgggtttcccaactccaagagcgcagagtgtgtgtctgagtttgctctagcgacccagcacagccagctttacagtatggttatttgttcacatgcctgatccttgtcacctaaaagcttcctgagaacagaaatcacctgggnttcagatctgctaggccgacgcgtgcccaacaccccacacacacccatcaaattagatggacgaggtgccagctacactttcaaagctagtgatngtcccacagcccaggatanacttgtncagtgaaacttctcaaaacacaatgcaattctctccttcacctggtgtattctggctcttactgtgtcactttctacttatcttccnctcgacatggacagaacangagtggaaaatcacaactttgggcttagctctgtccacataacctgggggtgcctgcgagcagtcggctactacaccccattcgtatctctactccttgttttttttaactggctgtaacacagaggccaagcgtttaaaaagcgtttaccttaggtaagttttggtcatttcgtttctnttaagagaaaaaaccttagagctgctttaaaggcgagtttttcgcgattactnggagctcatactccgtcctngggtacgcctccgcctccctccctaccgtgctgattcccgcgcctgtgtagacgaccaagtatttggcgttccggacggcgctggccagctcccggaccttcccccgcagctcctccgggtcgtcgcacacctgccaagacgccagggtggtcaccgccccgggccgccccacccgggaccgcccgtcgccccagctgctcccgaaaccgggggcgcccgcgcgccgcacgcggaactcgcctcctcctgccgccgcttcaggccctcgcgccgccggctccggccctgcagctccgttaccaggtccgcgctctcggccagcagccggccctcctcggcgctgcgctccgccgccgccttcctcaggatgcgcgacacctgcgggcaggcggacggtgagcggcggcgcgggccgggcatggccgggccggggagcggcggcggcgtacctggcggaggcgctccctctgctgctcctcccgcaacctccggacccgctccgccgctttgcgctcggagcggctcagacccccggctgccatcgctcccctggagacctgctcttccgcttccgcctcacacggcaggccgcgctcagggcgcatgcgcaagatngggccccgcccccacccaccccttccggctccgcccgccgcgtcgccccaaagaagcacctgccagtctctttaaaaggtttattgatcatatacaaaataaagaaaaccttatatatcacaaacatacactatgtacagcaataaatacccggggggccaggcccagtgctgcccctcctggacaataatttagcaataaatactgcgcagggcaggggtagggcaccaaggccactgccctgcaagaggtcaggcccctgcccgccctacacgaagtgtgagcgctcgggcctcaccccgcatccaaaccccagcccctcctcacttagatctttaataacctccatcccaccccagcagatcccggggtcttctcccacacacacaacctcccctggctagacctaggcagggcaggcagggactgatcaactctgcttggacccacctctcagcgccaggagagcaacagggctggacacgcgggcagcccttgtcctgttgccaggagaaggctttctgtgcccactcccngtttggttaaaggcttcagggactagcagattgagggggtgggaagaagggcagggctgggacacaaggttgctggaggggccaaagcccnaactggggtcaccaagaacagggaggtctcacagtttatcggggacacactctagctcagactcaagggacacccatggtatcaaagctgctgctccaggggcagggtggaaatgtgtgggactggcccagcaggtatggtacacacccaggacacaggccagaggcaggacaggcattagtctctcagacacgccctgcctctgtgtggcactgattatgtactctactctcccgacctgctccaaggccagacagccaacaggaaggcaaaaatacaccaaaaagaattattcagtggcttctgggggaaaaatcgttaatgtgttggttcctttcaccaaaccacagcctaaaaaagtaactcacaagatcccagagcggaaacggtgcagcaggctgcggctccgactttccagatgtggatgggcgctttggccaagtggccactccagagggaggcagcagggacaacatgggacctgaccatcgtcccaaagcaggctgcagccgctcagggccgtgggccgggncccntgatcaccagtcagaagtgtacacacatatctgaaacatgcaccaagagctgagccnagcaacaccagtgccaccccgagcagcagccaggggcctcactctcctggtgagagctgacctgtccctgctgggtattcctctgaaatctgagcgtccatgttaggataaaagaggagttggggcaaagttnaaggtggaagggaagacatatatcatggtttacttggcggacaagtttgagagacctggccttggccaaagccctcgattcgctgtgtcagaaaaactgaggtgagaagagaccaccaccctnctccaccaccctctcagntaggaaagcgggatcaacagagatcagaaggacagcacactcacacctgcacatgaacacaccatctatgtcaggaaatccaggggaaggggaaganggggtggagtggctccgcagggctgacctgacaggggacaggaacactcccctagacccagggaagtcgccccaaatccaaagctcttgaaaggaggtatggcctcgaaactccagaagcctcttctgccaacgcaccgaggacctgcacctcccattcagcacgcgtcgacccttacaccctcctcttccacactcccttcgcctccaggtctgcagcctggcagaggtgctcaaaatggatggccacccacagccaggacaaaagtgggggctgcacaanggacaaggagggcctgtttctccccactccgaggcagatcatgacgttttcttcatggatacttatgatatgattccaactaacgcctggattctacttagacaagatcagactgaggggagggggatgaagtcactaaatgacanagagtcaacagccaatatttccattttcaggctgacgcaggtagacacaggacttgtctctgaacacctcgagcaaagaaaagctcattaacatgacaagtgttgatggtgcctccctgttcccatcctgtgggcacaccaggccaaactattggataaaaatcccaccatccatagggttaagccctgttgggccacagtttttcatcttacccacatctgtgtgctttacagaagtctgggccccacagaaaagaaaccagcaacccggtgaaaggccagggctcacatggccagacacagggctgtagcctcttggaggtgggtaggggcaccccctccnccatcatatgcctacaaggagcctcctgagcccagccaggaagggcagcagcctctggcgaggaactgagagcaggaggcaggctgcgcccccacagggaggcacctccagcagaagccaagcagctgatccnctggaagacacagatcccaaagggaggcagaaggcaggcccgaagccaagagctgccagcgtggaccagcggagaagagggacaagacccggnccctgngagactgntagcccnttgtctgcactggtggagacccccaaggctctcagagtgaggcagggacaaggaagaaagggcggtgcccggtgggcccccacccactctgcctggaagcaccacccgcagcatggaaacacctcagggatcaagcgggcggcgagacctgcagcccacggcgcgggcagcctataggaacaaagctgaggccagaggaagacggccagggaacgcttggccatagccctgtggccacccacagtgactccctcatccctgtaatgccaccacccaaggccagaggtggtgggtgtggaagcagcgtggggcgccccaagggaccccagtttcacctaccccgccactagatcagcccaagccctagacacagatgtagccaaggctcagtggaggggggcatgacagaaccccnatgtctcacctcctacggaccaggagctggtggtgggcacagattccttgagctctgacgcagcaggcgccacttggcaccccagcccaggtccagcaagccagcagaagcaaaagcacaactaaacccaaaaaacgaacacgnggaaaacagacacaagaagtgacacccacaggtcaaaggtcaccagaagcaccagcactttaccgctgcacaaaacctcaccaggcacggacgacaccacggcaccggcaagagacggaagcaggaagggcagagngagtaagtcacntttcggtacaattgcaaaagatatcaaagaggacggccttctggtcggctcacggcttggcttttttttttttgtcttttttttaaactaagttttataaataatgtctgataactctgtgtatataaaaactaaactccaacagccacaaagaggtgtccgtaagtttacaagaaagggattttttttctttttttttcttttttttttaactagcaaagtttctattatactttcttcccttttccattcatatggtcaaatggtcttcttgcttgttttttttctaaaagacagttttataaatactctgcagctcttttttctttaacttttaaacatataattaatttaataactttgtaaaaggaacttctctcttttaaataaagggctatataaccacacaaataggtcatgtaaacagtgacacgggacccatcgcagggcacactggacccaccctcacgttaagcgcacaaccagnagatttggtcttgttcagtgcaacgggtcaggcctgagtgcacagcccctgggcccagctgcacgcccccagcaccactgcgcccaggctggtggtccacccatcagggccttcaagcccgccctactctcagagcagagcccatctcttcatgctgggctaagctgagctgctcccctggggctaaagagagtgaatccttcccagcccgcgagcctgtggccnactcgggagtggagggaacactgggaccctcactgctcggggacacgcgaggcccagcgtgcctgctccttctctctcccgcaactctctctagtccgttcccacagcaccaactctggactccaagcctgcatggccctggtacaaaaggggttggggcgaccccacgtcaccgccgaactgaccaatcccaacatacaaaacacacgacgacnatgacgagatcaaaggggctcagcccggcgcccctggggtacaggttgtgctttgcagggaangagagaagggtggggaagagagggaggaaagagaagagaaggaaacagagggacagggcagccaaattcgccatgtgcctagtggccccgcaaagacccgcctgggcagacgcgcgtccctacgatcgggcatccgtcttggactttactattgtgatgacgctggtggcggccaccttgcctgggacgaggggccccaggccggcggcaagggggccccgggctggcgccacggggctgcgggccaccgtccgggcgaaggtctgcagcgcctcgtacttggagcgcagcgcgtcgagctccagcttcatgctggcgttctctgaggccagcttctccacctcctgctgcagctccgccttctgcttctccagctcctccttctgcgtcacccgcttcacgcggcagctggcagcgtagccgcggttcttgagcgtgcgccggcgctgncttcagctggacgatctcctccttggacaggccccgcaggtgctggttcagctcccgcaccgacatggtcaccagctcctcatccgtcaggctggtgccattctcacccggctcccgcttcacctggggcacagtgcaggtggtcacaggccaagcgggcacgcccactgtgccccccgaccccagcccacaggctcctgtccctgcccactcaccttcaaggccttgtttcctttattgggggtcgtcataacccgggggcacagcgagcaggcgctctctgcaagacacggagcaggtcagtaccctggagaccaccctnngcnngcannccccccccccccngcccccggnncagttcacaagagcccttgccgcacagcccgccccagcctgctgtccaggtgcccagcccccaatacctgataggaggcagcccttggcctctcccnaggctgggctgagctgcttcnctgtccaccctgcccctagagaaccaggtgggaggtcaggaaggtctgacgggagaaggggaactgaaggctgttaggaaggcaggcgcaagacaaggggcaggggagagattagaaggaataagacgcgggagaggcaggcctagaaggaagccgggagctttaaaaataaccccggcactgcccagagcgcggctgttcctggcgagtcacgctgactcagcacattgcctctgcctccccgccgcgcccgcactccctggcccgccagccaacagcgccccacgagagccgcagcccccagcctggccaatagcaggtgagggccagccagtgaccctgtgtgtgcatcttccagnggtcctaccttctacagccacctcccctgagccggcctcggacaaagccccctgctccctgggtgcacaggggccccacgggggacctggccagagaggaggctacagggaaccccgagtctcccagcctcctaactttgaaaagcntgggggtgggccgtccatctagctctggtctgttggcaggactgaccagggagttcccccaccttccaggtggcaggccatcagctgggaggagcctggcccgaggcccctctagacctcccagtcggcctcctccactgatggagtaaccatcctgtggctttgggttgcaggnaagcagcccctgccccaccccatccagggtatttcacaagggnctcccacagtgagccaccccgggcctgcccaacgtgaaggctggcggagtcagcccctccgagctgcagcctgctctctggtccctgccnccgggtgagtgcccacagggccagggagcaaaaacaaaagtgctggggtggccggacttaacaaccaactcttccccactcggggtccctccagcactctgctctcactttcttgnctaaggatgtttctgggattcccagctcagcccagctcccaccagacccttgggcatggacccccgcctcatgctccatcccccactttccaggtttgatgcagacagatgggagactcctccagaggagctaggatcacttcaggaaattatgggctggggggcttcttactctcatcaggggagctgaagtgtggccaggcggatgcacacatcctcaccaggctcaagactccacctcacccnagcctgggaccaggaggtgaggctgcaagcacagagcagggaggggaggccagagacccctccccacagccanagccagctcagaggcaaggtcccgaggctccagccactggattcttccagataaaggatggggaangacctgagctggaggtcagaaggcccacaggagccctttcctacacgtccggcacaacactgccccaggagacaggccctcagccaagcatggaggggccccccagnccttgagtgcaagtcagggtgcagagacactgccctggcaccangcttctncccacccccnatcgcccccacccctgctgctaagcacaatgacagtggtgacttcctgaagagatcacacggaaaagtgcctcctcgacagattttgccctccgcagaaggcctgaactcagcacanagtgcaagnccatcgncctccntatcaaanggtgncgnccnggggggtgggggnnaggggcagnccctgagcacagccagtgcgttccaggctcctggcctggcctctggacctgggcntgagagggaccatgcagggatcccaggagctggactgaggagaagctgcccccgccctcctccagccctcaaggctgggcagagctggggcctgtcatgcaccctctgctcccagaggctaataagcccacctcacgcaggaggcacagatggtcacggctccgcaacctgcgagggtacctaggccacccattcacactgagagccaggaaagggagggagatttgggagctccgtctcctttggctaaagtagaaactcccgtgcctgaacacagacagccccacctggctgcaaagcccagcggccgaaactccccggcagtcatggcctctgctccataagctctcagctcctganaagtcactctttgaacagaacctaaaacttagtttccactgatgcataagtganctgagaagatgtacataaatgggccgcgcggtggctcacacctgtaatcccaacanctttggganggccgagngtgggtgngattacgaggtcaggagatcgagaccatcctggctaacacggtngaaaccccgntctctactaaaaatacaaaaaaatagccgggcgtcgtggtgggcgcctgtagtcccagctactcgggaggctgaggcaggagaacggcgtgaacctgggaggcagagcttgcagtgagctgagatcgcgccactgcactccagcctgggcaaaagagtgagactccgtctcaaaaaaaaaaaaaaaaaaagatgtacataaatgtccctccaggaccccaaaanttttcccagggcatcaaactccaggccaacggtcagctaaaacattgaaacatctggaatctataagccccggggctcactgagagtggancctgtgttctgtgtgtatgtgtggggggtgctcactgagaatggacctgtgtgtgtgtgtgtgtgtgtgtgtgtgtgtggcggggggcggggggcatccctgagggcaaaccacaaagtagcctaacccagccatgaaatgaactcctgggcaaaggnaagtcaaccttcgtgaatctccacatacccaaggaaaggtggctctggccacatcactcccaagctgccactttctaagcgtcctgggctgccaggccagacacccaacagggccactccctttgctaacttcacacaacgctgagaccccacttcaggtagcgacaactttagggtggctgggtgctgcgttctgccaccctgtgccatccacaccagcccatctgctgcaccccaaggctaggcaccctgaagctcccaccacctacagtctcaacccagactccagggccaactggggagagaggctgggctgcttcctcccctttgccgtttcctggtagagctgcccctgcttcctccctgcccagcccactgtcacccagggcttggtacacacacccctctttctcccaggacctcgatctctggccaggggctgtccaaccaggccagtcccagggaaagccgacttcccctttggctagctcggcccaccgaagctcctcccctccctcactcagggaactatttcccagtttggaaaactgctccagacttgggaccaggaccagctgccggaaaagagccgcctgggaaggggtggaccgcccggggcttcacctttgaccccgggagaacacctgcagcgagccacccccacttcctcttcaagcacccctgccnttcaactggatcgctcggcgctcacttaaacaggcaccccaaggcgccgggcctggccccctcccacatccccacggctccctcccacctcccgctggcggccttttagtccccgaggcccctcgctcgaatcccctccggtatcagcttgagcaccgagtgacctcacgctgatgactcagcaagtctccctccgggctctggcacgcgactgacggaacccgagccccagccaggggcagggtcttccnccgcagcacccccatcgccgcccctcctcccgggctcgccgcggacccccgcgccggggagagctgacgcggccaccggatgaatcagcagctgcgggccgggccgccgggccctggcgcggacccccgggcgcctcgctcgaccccaccctttcctcccngccgtccagtgcccctccctccaggacgcccgggtctccgagtccgctccgcactcgcccggctccgcgggtccgccgccgcccgcggcccacctccagtacccgggcgccaggggcaggaggagctggctcctgaccgctggggaaatcgaggcacgggccgccagcanggtgcgcggcagacccgaaaccagcggcccccgccgccgggcccccaaccgcccgcctagctccgggaggagccctgcctgcgcgccccctcggnnccnnnnnnnnnnnnngnnnnncnnnnnnnnnnnngnncnnnnnnncnnnncnnnnnnnnnnnnnnnncnnnnnnngnnnnncnnnnnnnnnnnnnnnnnngncnnngnnnnnncnnngnccnnncnngnnnngnannnngcnnnnnnngnnnngncnnnnnncnngnnnnnctnnnnnnnngcnnggnnnnngcngannnnncnnnnannncnnnnnnnnncnnnnntngnnntncnnnnnnnnnnnngnnncnnnnnannnntcnnnngnnnnnngnnnnnnngnnnnncnntnnnnnnnnnnnnnnnnnnnnnnnnnnnnnnnnnnnnannnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcccaccagaggccataaacagatagttcagagctatgagaacccaggtggctaaaaacatgaaaaacatggtctcaccagtaatccaagaaatacaaaacaaaacagtacggccctggcatttgcgaaacaggccctgaacctgcgaggtgtggccaccgagaccgacaggcaccacagcctgggggggcgtcggccagcgtgctccaggaagttcacaccttcgacctgtgtgttccaccctggacgagccatcccagagacaagggagtggacaaaactcagcgcccaaacacgttctcacagcattgttcataatcagggaagttagggcacatttaaatagtcaacatcagagcagtggttaagcaaatcccccagtgcctctcagaatcatataattgttgaaagaatgaatggcggactgtgatgtagcacgtaagtcacatggaggagggggtctgaagatcacggggatgcctgtggccatatcgaaggaagagcatgatgggaaaatccatcagcggctctcaaggacagagcaggggagagtgacttccaggaggggaagaagattccagatgctgatggggtgctggtgagcagtgcacacgcttgtcaaaactcatcaaactgcactaaaggtctgtgctttgtattgtgtataaattatgttctcataaagttgattaaaatctattatgtaaaattatatatagactttccctccatcttaaaatatataggaaaaagacaaaggaaataggttaaaatatcactaatggttcatttggaataatgagatttggagagttggacaatttcttcttcttactttgttttccgtggtaggtttgctcagtggtggcccccgcaaaagaaacgtttgcctcctagcctctgaatttgaatgtcaccatatttgggaaaagggtctttgcagatgtaatcttaataagagatcttaatatgagatcatctgagattacttggtttttagtaagtaacctttaatttttagaacaattttaggttcacagcaaaattggatagaagttacacaggtttctcatatcacacccccacacaggcatacaacctccccttatcaatatttcccatcagagggtacatttgctacagtgaatgaacctacagcgacacagcatcgtgacccaactccgtggtttacatcaggatttactcttggtgttgtccattctaagcgtggacaaatttatcatgacgtgtagccaccgtggtagtgtcacagaacagcctcactgccctgaaaccctctgcgcttcccaggtcacccctccctcccccagctcctggcaaccactgattttatacggtctcagttttgccttttgcaggatgtcatatagttgggatcatacagcacgtagccctttcagattggcttcttagtaatacatttgagtttctttcatggcttgacatctcatttcttttcagcgctgaataacactccactgtctggatgtgccactcacctactgaaggacctctttgttgttcccaagctttggcaattttgagtaaagctcctataaacgtctgtgtgcaggcttctctgtgtacatactttttcggttcatttacctaaataccaaagacagcgattgctggattctatggggagggtatgttccattttggaagagacggccagactgtcttcaatggtgctgcactgtcttgcgttcccagcagccgtgaacgagagctcctgttgctacacatcctggccagcattttgtgttctcaaaacacattctggccactctaatagatgtagagtggtatcattgttttaatttgcaatctctagtggcgtatgacgttgaacatcttttcataggcttacttgccatctatatatcttctttgatgaggtgtctgttttggtctcttgcccattttaaaatcaagttgttcatttttttattgttgagttttgattgttcttcatgtattttggatatcagttctttatcagatgtgtctgtggcttgccttctcattttcttgaaagtgtctttcacagagcagaaatttctaatttcaaagaagcccagcttatcaatcatttcttccatggatcgtgcctttaatgttgtatctaaaaagtcatcaccttacccaaggtcatctaggctttccctgtgttaacttctaagagttttatagttcgcattttacgttaggtctatgatccattttcagttagttttgtgatgggtgtaaagtctgtgtctggatttaatttctgcatgcagatgtccagttgctctatagcctcatttgttgaaaagacaatttttggccacagtatcgtctttgctcccttgccaaagatcagttgacaaaattatgtgagtctatttcaggactttatcctattctgttgctttatttgcctattctcatgtcagtatcttgattatggtgtcttttgcctctctctataaaccttagaatcagtttgtcaatgtctataaattaacttgctgggatttttattgagagtatgttcaatctacagattaatctagaacaactgactcgacaatatgtgagagggtctccaaaaggttcatggaaaatgcatattatgaaaaaatgcgtagatttcaatttcaaaataaactcatactaccttgttataacacatctgaacaggctctagtttgaggcactaagaagaataggacagcagtttcaaaagagcccctatcagggcaacatgaattctgccaactgaatctttgagtttctcaccattaagtaggatgtttgttttagttttttggtagatactctttaacaagttgaaaaaattctcctgtattcctagtttgctgagagtttttaatcacgaataagtgttaggttttgtcaaatgcatttttgcatccatggatatgatgatgagatttttcttctttagcctattgatgtgactaattttcaaatgttgaaccagccttgcatacctggaataaaccctacttttcataatatataattatttttacatattgttgaatttaatttgctaatattttgttgaggatttttacatgtatgctcgagagacatttgtctgtagtaatatctttgtctggttttggtattagggtaatgctggcctcatataatgagttagaaagtattcctgctgtttctacattctgggagatattgtagaggactggcataattttttccttaaatgtttggtagaattcaccaatgaacccatctgggcttggtgctttctgttttggaaggttattaattattgattcaatttctttaatataaacaggcctattcagattatttgtttcttcttgtgtgaattttggcagattgtgtctttcaaggaactgctccattttatctaggttatcaaattggtgggcatagcatttttcaaaatattcctttattattcctttaatgttcatgggatctgtagtgatgtccccctttcatttctgatattagtaatttgtctctctctctttttttcttagcctggcagaggcttaccaattttactcatcttttaaaagaaccagcatttgtttttgttaatattctctataattcctggtttcaattttattgatttctgctctaattttattatttcttttattatggttagtttggatttaacttgctcttctttttctagtttcataaggtggaagcttagacgactgatgttagatcttcttttctaatatttgcattcaatgctgtaaatttctaagcactgctttaactgtttcccataaattttgataagttgtatttttatttttatgtaattaaaaaaactttttagaaacagggtcttgctctgtcacccaggctggagtgcaatggcatgatcatggctcactgcagcttcacactcttgggctcaagtcatcctcttgcctcagtctcctgagcagctggtactacaggcacatacaactgtgcccagttaatttttacatgtttttgtagagatgggggtcttgctgtgttgcccaggctgatctcaaactcctggcctcaaatgatcctcatgcttcagcctcctaaactgctaattcaaaatattttaaaatttatcttgagatttctttttttttttgagacagagtctcactctatcgcccaggctggagtgcagtggcacaatctcagctcactgcaaactccgcctcccaggttcacaccattctcctgcctcaacctcctgagtagctggggctacaggcgcccaccaccgcacctggctaattttttgtatttttagtagagacaggatttcaccgtgttagccaggatggtctcgatctcctgacctcatgatccgcccgcctcggcctcccaaagtgctgggattacaggcgtgagccatcatgcccagctgaaatttcttctttaacccatgtactttttaaagtgttttgtttaatcttcaagtatttgggaattttccagctatctttctgttattgattttgagtttaatctgttgtggttggaaagcaaacgttgtgtgatttctgatttataaatctgttaaaatgtgtttcctggcccagaatgtggtctctcttggtaaatattcaatgcaagcttgagaagaattctcaatctgctgttgttgggtgtagtatttagatgtcaattatgtccagttgattgatggtgttgttgagttcatctgtgtccttattgattttctacctgctggatctgttcatttctgatagagggctgtggaagtctccagctctaatactggattcatctatttctcattgcagtgctgtgatgtttttacctcgtatatatttggcactctgttgttaggcacatacacattaaggattgttacatcttcttggagtgctgatcctttatcacctgtaatacttccctttgtctctgatagctttctttgctctgaagtctgctctgtctgaaattaatatagccactcccactttctttgattagtgttagcatggtatatctttctccatccatttacagcagatcttcaaataacatcattttgttcaacatcattttattttgttataatgataataagttttgtgcattctccccatgtctgtgtgggttttctctaggtattccagttcttcccacaccccaaagatgtgcacactaggagagctggtgtgtctccatggtctcactgtgagtgtgggtgtgtgtgaaatgtgccctgcaatggaaaagagtcctgtccaggattggttcccaccttgcaccctaagctgccgggataggctccagccacctgcaaccctgagctggagtaagtggattgaaaaataaatgaattattagtaaagtattttaaaataacaattcataaactatatgacaatcataaaaatacatgaccacaaataatgtggtacaaaagtgctcatcaagcctgccatgtttgctactgtttgtttttgaattgagtggtggtaggaggtgctcctcagaattttcagtttacaagcatttattccttgatttaacccaccaccactatgaccactgtcattgatgattcctcaaaattgagtaaataattatcttacttgttttaatctttcttaaatgtatgtatatcttacatttatttcaatgtttaatattataagtattttgagcctatatttagaagtttggtgatattgttgtgaccagaaatatgtcacaaaaaacttaactcttgtgtttatcaattagcctataggaaaagtggttttgttatacatcactttactcaaaaagccacagtttccaagaacctaccactgacgtttagtgaagacttactatacttttaatctatccgtgtccttctatgaaagtgggtttcttgtagatgacatatagttgggtattgttttctatctactctgacaatctgtcttttgattgatgtatttacaccattgacatttcagggattattaacataattgggttaatagctgctatattgtttactgctttctatttgttgcccttgatctttgtttctaattttgtcacacgttttctaccttttatggttttagttgaacattttgtattctttcattttctctccattctgagcatatcaactgtacttctttaaaaatttttttgtgtggtttcccttgagtttgcaatatacattatacaataatctgtaagtctactttcaaataacactatacagtttcatgggtggtgcaaatatcttataataacaaaatatttctaattcttaaccctttcttcctgtatcatgactgtcattcacttcatttatatgtgagcatatagatgcacacataattcagttcattgtcgctattattttgcactgttttctgtttgctaaattaaaaaaaagacaaagtttttattttacttcatttattcatgttccagtgctctcccttactttatgtagcttcaagtttctgacctacattattttccttctccttaaataatttcttctaatatttgttgtaaggaagtctattggcaaaaaattccctcaatttttatttgtttgagactttatttttccttcacttttaaaggataatttcgcagggtactgaattctagtttggtgtttttttctctcagcactttaaatatttcactccactctcttcttgcttatacagcctgcctgcctgcctgcctgcctgcctgcctgcctgcctgccttccttccttccttccttccttccttccttccttccttccttccttccttccttccctccctccctccctccctccctccctctctccctctctctctctctcttttctttttctttctttttgaaagcctgttgcacaggctggagtgcagtggtgcacccacagctcatcacagcctagacctccctgggctcaagtgatcctcccacctcagcctcccaagtagctgggactacaagtgctcaccaccacacctggctaatttttgtgttttttgtagagatagagtcctgtcatgttaccctggctgatattgaactcctgggcttaagcatcccacttgcctcagcttcccaaagtgttgggattgtaggcatgagtcaccatgcccagctgcttacacaatttctgaggagaagtcagatgtgattcttatccgtgctcctccacaggtaaggtgattgtttccctctgtctttttttcaagactttatctttgactctaaagtttgaatgtggtacacctaggtggtgtttttggttgtttggagtttttttttttggcatttattctgcttaatcttctcaaagctttctggatttatggtttggtgtctgacattaatttggaaaaattcttggtcattattgcttcaaatttctttcttctccttcttgtattcccatcacacatatgctacaccttttgtagttgtcccagagttattgaatattctgttttttttttttcctttttctccttgcttttcggtttgggaagtttctattgtcatatccttaagctaagaatcatttccacagccatgtatgtctagtcagctaacgaacccatcaaaggcatccttcatatctgttctagtggttttgatctctagcatttcttctttattctttctcagaattttccacatctctgcttacattacccatctgttcttgtcattcctgatctgataatttcaacattcctgccatatctgactctggttctgatgctattccgtcttttcaagctatgtcttttgtcttttagtatgccttgtaattttttgttgaaaggcagacataatgtactgggcaaaagaaactgcagtaaatggccctttagaaatgtagtgatccaagctgggtgtggtggctcacgcctgtaatcccagcactttgggaggcccaggtgggtggatcatgaggtcaagagatcgagaccatcctggctaacatggtgaaaccccgtctctactaaaaatacaaaaaattagccgggcgcggtggcaggcgcctgtagtcccagataattgggaggctgaggtaggagaatggcgtgaacccgggaggcggagcctgcagtgagccgagattgcgccactgcactctccagcctgggtgacagagcgagactccgtctaaaaaaaaaaaaaagaaatgtgttggtccaacatggggccaggagaggcattctctagttctctgaacaggtctcagccttttgaacctgtgtcctggactgtgaacttcactaatgcttttcagtttctatcccccttaaaggttggacaggatgactagaagggcctggggttcggtatttcccttctcccaggtggtctgggctctgataaaacctcaacaggcaaggctgattgaatagtttctgttgggggcagccttgttaagaacagaaggctctggcagactttaaaatgactcctttccccctcccccggctgagagcatgaggggatttctctctgatattcactgtgaggacctggtagggctcctggagataaaatccacaaaggcgtgtttcccataactgggtcccctcgagtttttaactctcaaagttgtccacactgaaccgcaattcatcaacttcatccaggttttcttatgccggcactggttccagtggaggtttctgctcttgggaagctgtgattctctgtatctgtcagtgtttctcttcaatttgccggggggcagcagtttgtcctgtgacctaatttctctgaaagatttaagaagagttgatttttcaatttttttcagctgtttacttgttaggacagagtgacaacttctaagttctacatgtatttttaattttgtgcattagatttttgatttctaaaaatcttaattggctgtttaacaaatctatctgtcattttcatagttttctgttacttgcaggtattttcaagttgatcttttacttctttaaacataatgataactaaaaataatatgtgtctgataattccattttttaagtctttgtggatttttgcttactattttttctgccagttctaactcatggtgccttgtgtctttgtatatgtagttatttttcactgtgagctgctcatgttgcttatacaattattgggggaaattctttgagtttgagatgaatgtgcatcccttcacagactgtatttgcttttcccaagctcctgtagccccatcaatctgaaatctttttaaactaattccacagcctaaagatttttggactcccaaggaacagagtctctgtgcttggaggcggcccgggcagcctggcttgtccagatggagctcacggccggggcctcgcctgtgactcggtgtgggcggggcctcgcctgtgactcggtgtggcccggggcctcgcctgggactcggtgtgggccggggcctcgcctgggacttggtgtgggcagtggccaggatgtgaccatggtgagaccaggccttgccagagcgtggacttggcagacacggctcctcccttgtgtgcggtgggagcttttggtgcgttccttacgttggagccggcatggagaagcagggcggtccctggggaccagctcctcatttgcacccctctttttaattaagtacattgtttatttttggtacctacttgtagcctagtttagggcccaccgcatattctaaagtgatgcacccaatggtgtccagagacagactagcctggagttggatggggggccagtctggggatgcaaaggtctagagaagcccaggccaagggcaggcagagcagggtgggagtgggagcaggaggggatgctgggggcagtggcagcacatgtgtcccaaaccactgcctcctaggtggggtgggacgggccccaacacaccacctggctgtgccccgtgtgggggtcaggggtgcagcgaggagggctgggtgagcagtggggtcagcagtgcggcgaggagggctgggtgagcagtggggtcagcagtgtggcgaggagggctgggtgagcagtggggtgaggggtgcggcgaggagggctgggtgagcagtggggtgaggggtgcggcgaggagggctgggtgagcagtggggtcgggtgcggcgaggagggctgggtcagcagtggggtcagcagtgtggtgaggagggctgggtgagcagtggggtcagcagtgcggcgaggagggctgggtgagcagtggggtcagcagtgtggcgaggagggctgggtgagcagtggggtcagcagtgtggcgaggagggctgggtgagcagtggggtcgggtgcggcgaggagggctgggtcagcagtggggtcagcagtgcggcgaggagggctgggtgagcagtggggtgaggggtgcggcgaggagggctgggtcagcagtggggtgaggggtgcggcgaggagggctgggtgagcagtggggtcgggtgcggcgaggagggctgggtgagcactggggtgaggggtgcggcgaggagggctgggtgagcagtggggtcagcagtgcggcgaggagggctgggtgagcagtggggtgaggggtgcggcgaggagggctgggtgagcagtgtggtcagcagtgtggcgaggagggctgggtgagcagtggggtgaggggtgcggcgaggagggctgggtgagcagtggggtcgggtgcggcgaggagggctgggtgagcagtggggtcagcagtgcggcgaggagggctgggtgagcagtggggtgaggggtgcggcgaggagggctgggtcagcagtggggtgaggggtgcggcgaggagggctgggtcagcagtggggtcagcagtgcggcgaggagggctgggtcagcagtggggtcaggggtgcggcgaggagggctgggtcagcagtggggtcagcagtgtggcgaggagggctgggtgagcagtggggtgaggggtgtggtgaggagggctgggtcagcagtggggtgaggggtgcggcgaggagggctgggtgagcagtggggtcggggtgcggcgaggagggctgggtcagcagtggggtcagcagtgtggtgaggagggctgggcgagcagtggggtcgggtgcggcgaggagggctgggtcagcagtggggtcggggtgcagcgaggagggctgggtgagcagtgttggcctcttccccgctctgcccagtacctagagtgctgccacgtctggtgaaggactcagtaaatacttggtgaaggatcagatgaagaaggaaaagttgtcagtgctgaggcaggagaagccaacctcagcatctgagcctgagtggtggtggggcagggtcctgcccagagaaaggtgatccccttcccgaggggagggctggcacggtgctcaggagcaagggctgcaggcccacaggacctttgttcatctgacctgtgtccccatgccaggctctgtcccaagcgggctgaggcagatggcctaggcagccgtcggtgaaccctccctggctccagagcctgtgcaggccccgtgggggtcaggctgctgtggggggcttgaggaccctcacttttggcccctggaggccccgacgaggcggcccttgaggttcaactggacagtattcccctgacccctgagcagagtgtggcatcaagaccccgacagtgaggccagtcccaggccgggattcggtgccctcctttaacgtgtgtgcgagtgcccacaggcctcactcagcctagaggaaggtgggcttgcgagctggggcctgtctcatgctttgcctccgtggcattggctgcgcctcactcctgcactgtggcttccatgtgttgaaaggcgagttccataggtgagaacagctccctcccagcacaccaccggcctttgctcgtgtacagtatttacccaatgccggtgaacacgagcagcctccatattcttgcaccaaggctggagaaggacccagcctgcaacacagctcatgaggcatcaggggccaagcacctaccgtcttgatgactgggggatggtgcccaggtctgtctgcccccactgtccagtggatggtgtgggaaggcattgcaggctggctgagcaggttacataacagtgcacacatgggtttactttacttgaaaccctaaaccctctgcaaacagccccctccctaatccctccctgttgactctgtagatgagcccagggtgctgaaagatgcagctgcatgcctctgcagccaggcccagggcctgcaacatccttcagccaaacgtgggtccctggggagcctctgtggcctcgccggtttcgatgaaggccagaggactggctgcacgggttgcctcagctctgcctgcctctctgttcgtgcctctctcctacctggcgggggtgtctctgttggcctcagagatgtcgctggtgctcaccctggtcacactgaccactgggcatcctcccaccccctgggccacttctgtctctgcacttggcttccctgcccacggcgtgccacccaaacaaagcccacagagaggctggcgccctcctcagccagatgcctgcatttaatagaagatgcagagacacaatctaagccaaaggaatgaatctctagtggtgaaatagcatctggtaagaggagagatttctgaaaggaggcccctttctccttctcgcccctccttgctctggaggctgagtccagctgttcctcccatgcccctgcccggagggcaacgtgcaccagggcctgagagcacagacaggtctaggtgggatccgtgtcagcaccgcagggcacacgaacgactcggcaggctccagagtttggctcattttctgcttggtccctttttgatgcctgtgatttatttataacaatagtttgcataattccaaatgtggtgacacagcctgcagacgctgagtgaaatgaagacagaacagatttttcagaggggtagtggtgtggagcaggctgggccgcgagtgatagaactgagccccaggttgtgctcggagtctcctggtgccagaacactgggcttccgtgggacctgaggggctgaaacggtgctggacctggacccttcctcacagtcaccctcaggtagcccatctcagacaggaggggaccccttgtcccccatccccatgtttggagcgtgctgagctgcacacagtcctccctgggtctgagaccgctggtcctgcccccaccccagctctctcccctctgggtcttgggtttcagctgtgatgtcatcctgcttgcctggagtccagaggggttagctggggggctcttgtttgcccagaattccttgtggctgtccagtctcagtgcccactgtgatgcctgaccctccgtgagagccagcactcaggtcagagatcgtaacctcccgagtgctgagtgtctccggcgccgcccaagctcagggcatgtttgtgtctcagttcagggcatgtttatgaattgacaaatgaagttttggaagaggacaagttcacatacacttgaccaccgagagatagagggagggtttcacatagctctctaccatgggggggagcggttttcccctggggcctagtgtgtggccctgtccaagctcacccagcctccccttgagggagcaccatagattccggatgctcagaccatgttggaagctcaggcctttggaacacctcagatcctactccagcctttctagaagctggggtttaatatatcttagcagatgggaatgtcctgtcactcagagaaaaggctgggcaaggtctctctggggatgaaaccacttagcgctcttcttttgggggatttaagcgcaaatgattcagaaacagtcaggcttcatttcttgacacggggctggaggaggtgagaagggcgttgaccaaatgaaatttgggtttggtccaagtcagaaatgtgtgagatgaatggggacaggtttcccgagcccatttaggtctgtgcacggttaccaacagcagcagcggaggccggggcaccagggtggggctcctgaatgggacatgaagaagggttaccccttctgccataagcaacaggcagggcagattttacaaacgcgttttctagcattgtttctttcagcccaaaagagttctgtgagttcatcttcagaaatcaagtttctgagaggtggggacatccaaggacactggagattgggatgtccgggaaaacggggtcttcaggcccgatctctgcccaccttccatgccctttccccagcctgcccctccagggtgcagcctccccatgccgacgaggttccctggcacaagcaggctggtgtgcatgtctgtgctttggctgcaggagctgcagagagggtgatgtcaggtccatgttgtgtagagagaattccgacatcgcccagcaggtgctcgggtgccgtgtccagcagcttggtgggcttcctcagcccctcagacccccaaaaccattttctttttttgcatccatcaatgtcccgcacaggagcaggcccctcccaggtgaggtgggcttggatgcaggagggaagtggtaaagacccctcccagagacaatgcagaattggcctacacgggtggggcattggaagccagctctgggggtactgactcaggaagatgtgcctcagctgagccccgggcattaggaattggctgcaggcatggacagtggacacggagcagggaggcccaacgctacctgcctacaggggagcctgggacgtgggcttctgttccgcagcctgcagagcctgctggagccgggctggtgtcgaggaccacctggcgcccagcaggtccccctgcagcttgttttctgggaaagcaatggactgaatgcctgtgtccccccaaattcatgtgttgaaatcaaccctcaaggtgatggcatttgggggtgcagcctttaggaggtgatggggtcatgagggcggaggctcatgaacggggttactgcccttacagaagaggcctaagggatgcccctctcttcctccacatggcacagtgagaaggtggctgtctgcaagccaggaagagggccctcaccagaacccaactcagctggtaccgtctgcagcttccaaactccagaactgtgagaaataaatgtgtgttgttattaaatcgtcttggtgttttgctagagaagccctagctaaggcaccttccgttctcccacctcttcctcctggggcaaggcctgggtgaggccccgtaagccagcgagtggcttcaagctggtggcacagccagtttcaagccgtctctggggtacgtggcacacacaagagccgggctgtgtaacctgcagcccacggctccacagaggggctgtgccgcccagggacactttctctgcaggtctctggcttcaaccctccttgccgcttgtgtgccggggtgcacttttggggcagctggcagccttttagcctcagctcctctgtggggacagagccaagactgatcgcaaggccaagacctaggagtccaggggaggccctcggctctgtccttcctgccggcccggctcctgctcattccactaacaggcatctccctgatgaaatcctcgagaggttagtcctgtctcggcggcagctgctcagagcaccgggctatcctctggcccctccgaaagcatggccctgaatcactgggggagcctcaccaggcagagatggctcatccccatggacctgggcccccgggtcccggcccccctggcctggccagcacctgacgctgctgtgaggagcatatggtcaaatctgcacctgctgccggccacaagggaggagcaagtgctgagtgcccctgggccacctgaccaagaggtgtccttgtgtcccttgccccctgccccagacgtgcctctcgggaccttcaggccacggtgctatttattacccacttgaggacaaactcggagccaacccacaggcctatgtggcaggactggccacacctgggcccagacacgctgcagctttgcgactccggccacagatcccggggactgactggggttgcaggccttgggccagcccctgaacctggccgtgcctcacagagctttggtggggatgacatgagtggatacattcaaagggtttaaaacggcgcctggcacactgcatccgtgctgctgtgattctatttgagttggtgctttccagatcggtttctctctgtgacgatccagaatctgtgttccgtgcccaggcccaggagtgaggagaggccaacagggaggagaggagggctcctgcctcagggaaacggagcccgtgcaggaggtcctggccgggcagcatggggctcaggacggatgcccgtggcgggtcaccccccacagcagtcacagccggggggcccccaggcctcagggttccacggagcaggttgggcaagtgtgttaggaccatcagcaacctgtgtgcagccaaagacagcaaggacagagccaggaactccggcttctgcctcctctccctgtgccgcctctcctggctgagggctggagagagaaggccacggagcgagagtggcagccctcaagggacgcaggctcagtgctggctgcaggggagctgcgagggcctcaggcgagggagctgcgaggaggccgctgcggcccagtccgtctgttccctgagctgatgacaaaccgtttgttttctgtgaaaggtgctttactgggagaaaggctaacagtgaggcagctctgaagtgcttttattctcagtttcctctgtcgcttaaagaccacttcacatttctttttatttacacggataaggatggatgagcttgatgttctcccaccttcctcttggcgcagctttcttctcctccctcttggaaggactttcgctttttattattattttaaacgttttaaacaacaatctcccaggcgcccaacaaaggcgctactggtgccaggtgcttggcgcctgccttccctgacaatacacgggccacatcctcagcccccccggctggtggcctgtgactcccgccccagtgccagactctttatttcattttgttggcatggtggaaaacactggcttttcaggaggtgaccctgctttcaagagccaacctttggagaaaacaggacacagaagctggttttggctgtgaggccctgacgcacggatgcaggttgcacaggccccacgtcctcctcacagcctgcctttccagctggctcaggagtccctgcggcttgagtttatccagaagcttccctttctcccgcaagagctactcgtggaagagaccagttttaagtgattttgccgcatttgaccttttgggtatttcagtgaaaacaaaacctcttccacaatgcaaaaacttggattcaacaaccatcgattattccctctgggcacctcacagagctggggtgaaggccacctggggttcacgggactcaccgttgggtgttggcattgagtcttgtagagcagggactggcaaagtcagagcacagggcctggtgtgaatcccacctccttccccgactggccaggggacctgcagcaagcgctcagcatctctgagccttagtttcttcctctgcacggggagctcagcggtggcacccacttcatttcagtggtgcccccttagtcatggatgatataaaaatgttgccacaaaagtaaccaagacaggtcgggatgagatatgcacgacttctaaacccaattagggattaattaggaacatacaataaattcccccaattcataagaaaaagacaggaactccggtggatgaatggacagatgatattaataggcaattttcagaggaatttaaagcagcagacagatccatcatacctgccagacaggtgtgcgctgcctggtgtgaccctgctggaggcagtgagggcagcagggatggcagcacctggcggctaggactcggccaagctgaagttcatgcacccgagagccacagcctctgccccagacagggatcagaagtagatttacactcccctctgaaagaacaacaacagagaaaacacacaaagcacatttttcaaaaccctgggcatcggtcgcccgcactccgccaccgtgagtacactgcgtggacccagaaccttgactcctcttgtttctgtgaggctgggacttacgggtgatgtgcagaggggccagagctggtatttagagaggaaatttgggggcaattaaaataggggttctcgacaagtctggcctccccgagcccaggaccaccatagagctctgaacagaggaatgagctggtcgccgtgagaggcggctttgccagagctgggccagggggaaacagcccgttcaatcaggacttggggggtgggactggcttggggttggttggtgtgaggcggggagaaggagatccggaagagtcctcgacggctgacattcacgtcactggagggggccgattggaggggtcagcgatgggctcaattttgtgccctcttgagttcgaggtgtctgtggggcctccagctacagacatttgtgtgttggaaaagctctgcaaaccctgaaacctggggaggcccctggtcttgtctgatggttgtaggtcatggtgacctccactagggcatcttcactcccctgagccacactgagacactgggtttgattgagactctccagccatgatgacaagggttcagctctggtaagccatgtgcagcctccccctcaaagaccagatgccacccacccagggccccaaacatcctggcccagcgggtctgctcactccttgatgagcttaccttcctcgatcaccccaacatgcagagagaaaccctttgcccttcttggagggaggggtcagatgctcactctgcagatccctgaagacaagcagatgctccctgagtggcctgtctgagggattcagctggcagctgggtatcctcatgtgtgcagttcctgagtgagcactggtggtggggaacaggcctggctttccatgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccatgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctcgggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctgggggggtgcaggggggatgggcctggctttccacacccggggggtacagcggggatgggcctgtattccacacctgggggtgtatgtccaccacccagatgccacctctgtgtcattcctggagggcattcgggcatcacctgagggtggggagcactgccctgacccacatgacccccagcagaagctgccactgtcggccctgggctccgggtgtcagcgtggcgctctgggcttttcccacactggggggccatttcaggatgtggatccctccaggaagggcttgctgagtggctgctgtttgctgggatgggtgaggggtagacaacaggcactcaggagccatggttgggacagaacttatgtttgtcagccaccttggaggggcgacctggagagctcggacaaccttgcagcacccaccagagagcttagcaccaggacccagcagagctctcccacgtgcacacagactcactgctcgtgtgtgagaaggggaataagtgtgactgagccttctggaagttagggcctagcacagagggtcccagatggcccggagaaccaggtcctgtgcagctatccagagaaggtccagtcaccagagacagacagctggagtgccagggccctggaggtatcaattgcctttgttttacatgaagacattgaacttccacaggagggcaaacgccctggctaaagtaactggcggggcagcgtcaggaactcacaagcccctgtggtccgtgcaggctgccgtcgatttgatgagcacagcaggtccaggcagagagacgctcacctccagctgcggttggggtatgtctgggaggcctgtggggtggctttgctcctccaccttgggccagggtagcctgtggcaaagacagtctcacagtgtgtagtctccttgaggtctgggcctgtccgcagacaggaaataatgagaccggctcaggacagggccgggctggcctctgtgttttgtgaaagttcgagtttctacaccctctgagaagatgctgggccctgagggagggtgtggaccagaaggaagtcacggggtgagtggagggggagggaagcttatgtgccattttaagaagacgacagcaaaaacaggaaaatcgtatttatctgaatcctatgtgattccacttgaattttaaataatttagacaaaagtaaattggcgtttacttttgcattagccataaggagcagaaggagaaatttgctccctagaatatgagtgttgacgtgttgctgacatcaaaacagaatttaaactttgaggaaagagagatgccagtgctgccacaaaggcaccgacgcccgagacagcagggctcgtgtttcttcacgcagaccatctgtgccgccgttggccgtcggaggtgatgaaactgggctgcttccaatgcattccagaatgtaaacccctcaccgtgtttcttcttggtttgatccctggagtgcctgtgctttgtcttcaagtcacacttgggattttgctagttttccaagattatcgcattttttttgaacaaagtaaatcagtttccgacaatgccactgtcgtgttagggtttctcggcgtgtcgcctggctctggccggggttgtgtgtgacgcttcctacccgtgctgccttgcacatttatggagcagggggtttgccggcagcggtcttggttccttataatcctgtcatcgtcctcgtcgtcagccccctccttcccctgctcttcctctgttgtcccagcaagactttcaaagaaccagctattgctcaagtggtcttttagagaatgtgcacacctctcaaccactccacaacacctcaagattgcagtggttgtgtttcgggttcacatacatgtatatcgagactcagggaagtccagggccacacaggaagtggcagagccaagatttagacctgatctagctccaaatcccagcttctctgttgctggccacgcaggatgagctctgtttcccaggcaggctgagcaaatgtccaggatggcaggttcttggcagggccctgggggctgaggccacagaaggcctcctcacaggagtgggggtgaagggccccaggtccaggctggatgaccttctgcccttcctgatgcgggtgacctggctgtgctggtttgaagtaaaaacgctgttggcagagaatcgagacgcggggaaggttagttcagggcagggatgttggtgtctgcgggtgatgactgcagcctccctgtgtgttgtgtttcccggttggcacacctctgtttattgtctgcgccagcctcataccccctttccctcagcgtatttccttcataacaggatggcagactcagcggctgctatggggctgttccaactactgaaaacactgagataaggcccacggtggcagaaatccctgaggctgccaagggtgcccacatcccagatgccggggctctgagagtcgcctcctctgttcttagttgcctcggatgtgaacaggcggccatcagggggtgtcatcctgagccctgaggtggggcctggggtctgcactcgaattcacggtgccctgatgctaagttttaattcttaaaaagcttttctagctcaagatactcctcaatatattaattattggctgaaaaaagcctaaatttttaatcttgcaaatgctagaatttctgagctccctatgttttctctcaattctgctgcaagcttggctttcctttctgagcttatctttttcttgaggtactttatcaaatgcagtagcaatgattattcactctagagacattttgcttggaaagcttttcacccaatgccaggattacattgggtatgtttcctgctttctaagttattacaggagcccatgttagtgattttttttttaccattacatgtcacaagttgccattccccgactttctaaagtagtttattcaccacccagtctatcagccagtgccacatattaatactttaggttttattatggcagcacctacttttggcaccaaattctctattggtcagctattgctataataatgctgtgtaacaaatggccccaccaatcccagtggtttagaagaagctgtttgtctctcatgcctatgtcggtgtagtggccgcagcatctacttcaggctgcaggtgcctctcaggtgtgtggcttggctctcattttgagacctgatggaagaggcagaaggtccccccggggcacttcccaggccaggcgtgcaggagggcaagtggaagcacatacttacctgtactcagaactgcccccactgtccccttccacacttcagtggtcacagcaagtcccatttccaatccatggtgctgggactgggagggaaggaaggactgtgagtgtacaatgccacctgccacaggaatggctcaaggatggaggcaaagttaacaccaggagttgccctgtccctctgctcctgaagcccttggctttgcagagatgatgtggtgcagtggaaaggacacagtgcatggcgggccagctcggctgccctgacacactgtggccagctggcctctcctcggtgtccctggagctgcagctttgatgccagggtagaagatgagtgggaggcggaggggcatttccagccaactctatacactgagaagcactaaagattaacaggtgactgtctgggaagagccagctttgtaagagacactgagaggcaccacttcccaggccttcatcttccctctggatgggtggaggaacagggacaccaaacctgacattgctcccatactgagtgccagccatggccccaccttgcacagcccatgcctcaagggggccatggctagcactatctgacaagaggatgctgggcaggtgggtgggagcagaggaccaggtgaaggctggggcctgtgtaccccagttgaagggagctagatttaactccctgagacccaagaagcatccgtctggccaccccagtctaattggctaggaatttggtggtggcacaggtgagaaggtccctgctccgtggagcttgcaggttctggaaacaaccccaccacatctgttgcaacacctgcagccgtcttcttgcatctttgctttgtgctggacgcttccatatggaacacctaacacaacatctgtagtgggctgagggtaaccctcaaagatatatgtccacatcctaattcccagaacctgggactgtgaccttatttggaaaaggggtctttgcagatttaattaagtgaagggtattgagttggggagaccattcttgtctatctgggtgggctctagtccactgataagtattcttagaagacagaagaggaggaggccatgtgtccacagaggcagaggctagagtgctgtgggaccacgccccctctggcagctcgtgaggggccacgcctcctctggcagctcgtgagggacccacaacagggaggactggggccttgctgggctggagagcccagaggaacaagcagggggctagggcccctgagatgctgtatgactggtccattgttcctgttcctttcccatagaagaaaaaggagagtagtttggggacagattcatgcacatatgcacacatacatactgcacacacatacatactatatacaatacagtgggtatacatatagacacactacagcacatgcacacacacacacattctgcacacaatactgcatgcatgcacatacggcacagcacatacatgcacacatgctgcagcacacacaatactgcacacagagcatacaatcctgcaagtacaccatacacgggtgaagagaaggggcatctgtcagtggcctactcttccagaccctcattttgtccttacagcagctctctggggtgggcctccccaactccctttaatggatgaagatgctgagacttaagggttacaaagtctgcttgaagtcacaaggtgctgcgacttgagctcagggccaggtgaatccctgatgttcctggcaatctgctcctgaagggtgcagcagggcctctctggtctggttctccctcttcctgtaacctttgaggtagtgcctgcaggaaccctgggacccccccacccccaccccaatttgcctgctcctgttccctgggctcagcagagtcaccatcccagccccaggacaagtgtcctccttggtgggggacatgtggtcattgctggggcgatacagtgagatgtggccacacagccatgtccagaccttgggcaccatgctgctcatgctccagactgctggggagcacctggtcctggttgtgtctggctttgggtccttcaatttctgctgtctgctttcctgtcattgctcccacttctcaaccctgccttggtagcttctctgatatgatcaggcaagatcttagagcacagttgcatgtttatattatagcttctctatcactcctgtgggtgtgcacatgttgtatggtgtgtgtgtggatgtgtttctctacgagtacagagcacatatgtttgcatgcattctgtgtgtgcacaaggcatgtttaacatatctggtgtatacacagggtatccataaggtttatgtggtatgtgtgcatactgtgtatggtgtacttgcaggattgtatgctctgtgtgcagtattgtgtgtgctgcagcatgtgtgcatgtatgtgctgtgccgtatgtgcatgcatgcagtattgtgtgcagaatgtgtgtgtgtgtgcatgtgctgtagtgtgtctatatgtatacccactgtattgtatatagtatgtatgtgtgtgcagtatgtatgtgtgcatatgtgcatgaatctgtgctctgaaaagaaagccaacacagtggctggacaacattctaccagtcccttgagactatcaaaagtcagtgtgttcagtcacacagaggagcctttgaagacttcagatgaatgactcaggagcccctcagtcatctcagcagaagacagagataggactatgtgaaaggcctagggaggaccttcttgtgaaatagagtgaatcctgtgtgtgacatacacaggagaccacaaagttcttgagaatgttatatcagcagaaacactgccaacttggactgaagggaacagagaaagtatgaaatgaaagatgaaagagcactgttggactctccaaaattctgcaggaaggaagcaggctgataaaaccactcagtggcaaacatgtgctacctttcatgaaaaaggaaggatgactccaagggtggagccatgagcccagatgttggacctgggacccacagaggattattttctcaggccttgaaatctaatgtttgcttagctggtttttcaaagtgcttgggactgaggactccttttttccttccattttctccctttttgaatgagaatgtctataactgtcaactgatgcctgtcctaatgttgggtctgacagcagatcatttgtttcttgagttttgcaggtttacaggtggagcagaattatgcatctggatggattataccctaacccaaccctaatttacattatgaaatttgggacacttgaactaagtaaatttagatgagatttctggactttgacttaatgctgtaatgaggtagatgttcacagatgctggggtggagtggcatccttgtgagtctttggaagccaggggccaactgtagtcagcaggataatggcccccaaagatgtccacatctcactccccactaccttatatgtcaagagggagtttgcaggtgtgattaaattaagggtcttgaggtgggggattatcctggattaaccaggtggccagtgcaatcatgaaagtcctcacaagaaggaagcaacactgttagcatcagagaagatgtaactacggaagcaaaagtcagagtgatgagtttgctttagaggtggagggaggaacccagaggcatggaagataggtaacctctagaagctggaagaggcacggaagtgaattctccccagagcctccagaaagaagagactcttgctgacgccttggtttagtccagtgaaacccatgtgggacttctgatttccaaaaccataagatgataagtgtgtgttgctttaagccactaagtctgtggtcatcggccgtagcagcaataggaagcaaatacaggcatgaacatcaaaagagcaggagacgggcattccggaagtcgcaggaagaacacgctttctactgctcctgttgggtgttgtcgatcagccaagatgagggctgagaactgatgccagggttagcctttgccggtaacatcggcaaaagcacgtttagtggaataggggaggtaaaatctagcttagcgaggactcaggaaagaccaggaagagaggaagtggagaaggaagactgtgttcttagaggggcatcttgaaaaagagcagagagacagccagcagctggggggccctggccggcaggagaggggacagcatgactgttgttgagggtggccccactgagggggcaaccagagctcctggccagcctggagtgggggacggcggtgggtctggctggccaggcacagttgggtgggaagatggtgtggtcggagcacgtggacattcttttctgattgcttctattttctcagtgagatgggaaacaatcatctcctttttgctaaatgtgctgagcaggcttgagggatgcctggacttcagcaggaagcaatagtcatgcctcgcacatgcggctttcaatcctgtttggttggagaaataatataccgcccaactagtttgttttaaattagacaaacaccccggagcctgcctgctgctggagacggctgtgtttggagtggggctctcggcggtgctgaggtcagctctgtttgacattcctgatgtgtgaagggcgcacttaggacaacaccaccaggccacgggcgtgcagctccctggagctgctccaggggccctgcctgagaaatgttccagtccttgaaatttctccccagttttaaacatctgttggtgcttgtggaaaataaggtcgggattgttgtgctcaccgcccgtgaaagctgccattgcacggtctgtaaagtgctggtgatgaacacttcacaccgacaggctgagcctcggccctggccacgtcgctggggcccagcttctgatcagtctgtatggttcagctctccgtggagttaagtcatgacaaccaaggaacacaggcatttgaggggatagctctgttccctccgccatgtcctggggcgagctgtgtagacgtctgttatcttgataaacccaaacctcttggggccaggtgccctgtgccttcctttgtccttctgtccacctggccttccatgagcctctggggtggggctgtctcctttctctcctgacttcccaaagcacaactgaaagcaaactcttccacccaccatgagtctcattccatctctccagtgggcgagacacgtagtgttttgttttatttcatttgctttgttttttcaatcaagctgaggccagcttggaggcctgttttccttgggatggtggacacatggatctcaggagtttgggggtgccccttctggtcgcaagggaccttctggaccctgtgcctccctcccaccagcctcccctgacaccgcctccgtgctgctcctctcccggtgggctccaccctcactagggcttcaaacctggaatgctctttcctggcctcctgcctgtccccttcccaccaagccccccagttcctgctgagtgccacttcctggctcagctgctcccatccagtgctgggctcagcctcgtcacccacgccccaccataaagggttctttacagcagatggcatcgctgtcggccccccaaccggaggcgcccttcagggcaggagcctgtttcttgtggaagtgtcttaagccctaaaacggtgcccagtgcacagttaaataaaaatcagagccccaagagcaaaccttagcccctcacggtgactacagcccttccaaagaggggccatatcacgtgcacagtgaccctctccacgtgggtcccttggtttgtgagggccttggtttgcaggccatagactgacacagtggcacctggtgtgaggggaagagggtgtggaggccacagacccacacggtggtacctggtgtgagggaaagagggtgtgggggccacagacccacacggtggtacctggtgtgaggggaagagggtgtggaggccacagacccacacggtggcacctggtgtgaggggaagagggtgtggaggccacagacccacacggtggcatctggtgtgagggaagagggtgtggaggccacagacccacacggtggcacctggtgtgaggaccttctgaaggtacccgtgggtgaggggatcatttggatggattgcaaaatggccatgtggctttagtgacacctttaggatgtaataaacttcagagtcaaccttaattctgggagagagacatcttcacttttctggtgccataactgcctctttgtggaacgcaaagcaaaactaaagtcatttttcttgtttgtttttaaggcccttcaggctctagggtgagtttctggtttgaggggaaggcctttcctcctgactccagccctccttgacaaggtctccgtaaagcatgctttctcttagggaccctcagagggaggcttggtggggacatggggtcagggacatcatcaaatgctagacgcccggctggggctgccccgagggctctgagaggagggggcaatcctgcgtggccaggtgggtggtgagtgtgacctgggtggttggcagtggcttccgtccaaggtcctggccaggagcggaatcccacagccacggcaggccattagtggctgagtgaagtttgttcagggtggcctgaccaaaggcaggccctgaggacagctgttgctggctcttggtggaaagaggctgaggccaaagggtttataggtgttcaaattggaaagtggaacaggagacctaagtacgctccctctgaccaggttagggggtactgatggggagtccctcagtagaggcaggggccacctcttctgaccccaagggacccaggccaagaaggagccccctctcccccagggccagggggaccccagcctgccccacactggcactttgcagcaccagggagagaccaggcctcctctgggacaggttccaggcttacgggagctttggtcagaggggcagccacccctgcccactctaagaacgtgaccccagaaaggggcatcatttcttcaacagaagaggaggcgagatgagcttggtgccagttccacggagccacagtgacataaccctccgaacattcgtgaccaaccacggagcacagtgacataaacctccaaacattcatgaccaacctcgattatacagtcacacccagccccgagtggatttaccagagacaggatgttccccaccaggctctcccactaggcagatcctcagcacttggctcaagagtggaacagaccccactagccattgcaggccgttgggcaggcagccctccgacctcagcccatgtgcatatggggtgggggacccgtgggcaaaacttggggtcctaacctgggggggtcaaaccctccacacgcaagtcctggtcagaatcactcagaactgaccctcccctgtgccagcccctcccctgtaccagctcctcccctgtgccagcccctcccctgtaccaagcccctcccctgtaccagctcctcccctgtaccagcccctcccctgtgccagctcctcccctgtgccggcccctcccctgtaccagctcctcccctgtaccagcccctcccctgtaccagcccctcccctgtaccaagcccctcccctgtaccagctcctcccctgtaccagctcctcccctgtaccagcccctcccctgtaccagcccctcccctgtaccacctcctcccctgtgcaaagcccctcccctgtaccagctcctcccctgtaccagctcctcccctgtaccagctcctcccctgtaccagcccctcccctgtaccagcccctcccctgtaccagctcctcccctgtgcaaagcccctccccgtaccagcccctcccctgtaccaagcccctccccagtaccagctcctcccctgtaccagcccctcccctgtaccagctcctcccctgtgcaaagcccctcccctgtcccagctcctcccctgtaccagctcctcccctgtgcaaagcccctcccctgtcccagctcctcccctgtaccagctcctcccctgtgccagcccctcccctgtaccagcccctcccctgtgcaaagcccctcccttgtaccagctcctcccctgtaccagctcctcccctgtaccagctcctcccctgtaccagctcctcccctgtgccagcccctcccctgtaccagctcctcccctgtacaaagcccctcccctgtcccagctcctcccctgtaccagcccccagaccctgaacagcactggccactacacggagccaccaccctggccctggcctgggtgggtgggggtcccccggggagcacagcgcagtgctagggcccctgtagcagattcccaggagacacacacccagctgggcctgctgacactagccctgcattcccacaccccctcccctggccctctcagctgccttgtcctctcctggtcagctgcctggggacactgtcgcgatgcctggcccctgaccttgcccgaagctcctcggtgtctggacattcagcccgacatgctctgaggtttggggcaggtccagcactctgtgggtccaccccatcagccctcagggtgggactcatgcagccacagtttgagagttccaggaaccacaagtcctgagtcagcgggcacctgaccccttatgtcacctgccccaggtggaaggagacgctacagggaccaagcatggttggtaaacgtgtgtgtgtatgtgcactcacgcctgtgtgttaaaatgcttcagagaaagagcagcccaggaacgtgggggttggacgggatgtggaggtgtgggctgtgcctaggggtccctcctggggctgtgtgggtgtgagtggaggactgaggaaaagcctccttacccgggagtgtgtgggggtgctgtttctcgtatactttatttcctgttttaacacatgtgggtgtcctgaaataaaagccgttagccgcccacaagaatgagcaggtttgctggatcacagtcccccacccggtgccaggctgcctgcctgggagactcagggtcctccccaatcctgcctccccacctccacacaagggtgaatctgaagccccaggcacccacgccaggggaactgaggtagagcagacctccagcatccccccgtgacctggcagatggcagtggacattgccctccccagacacccctgtgagttgtcagctctgcctgctggggtggagcccctgacttgggtgagccaagggtgggggggagggtggtgaaccagccggccccccaggtttcctgaaccctttctcagtctcctggaaggggctgaggggcctggcaccttcccaccagagcagtggtccccaacccttttgacaccagggacaggttttgtggaagacacttattctgtgggtgttggagagaagaagggatggtttccctctcagatcatcaggcattagattctcataaggagcggacaacctagatcccttgcgtgcagttcacaataggggtcacgctcctgtgagaagtgaatgccgccgctgatccgagaggaggcggagctcagggtcaggccggtccaccgctcacctcccaccgcgcggccggttcctaacagaccacagcctggggacccctgctccagaggacggggagtgtctctctgtcatccccaacgggccagtgatcccgctggaggggctggggctgcacaggacacaggctcagctgtgctgctggccacccatgacccaatcagaggctcaggtcagagggcaaagatgtccactgaagcggctccagaatccctcaaggaaggtgacatccgcttcgcttcctcctccagccccaccttcgcttccgggaccacagagcccctggagcctgcacgccacggagtctcccactgaggagtgaggaggcctcttgtggggacagatctgggtgagtcaggaggccctgcggggctgggctgggctgggcttaggggctggagcggggagggtttctcagactggagtgggagacttgaggtggagatgtgggttaggtcagggtcaaccctgaaagattgagaatcacacggggctgctcaccttgggcgtgaggagcaaggtctctgggactgactaggtgaagaccggtttcctgggacgggcacgacagggacttgagacccgtcttaggctgtgtcagggcagctgagaaacttgctggcttgtgggtcatggagccccaggagccggtcgaggtgcaggagggggcctgggtggggctgagtcaagggctccggccaagcccctgtggcccaggcggtatttgtttatgcctcatggccgggaggagccactgccttcaccacatcccaccggggtggggcgggtaccaccctctgggacagggaaacttcaagtgggaatttgggcaaatttgaactcagctggattttcagtttgttgttctttgaaggaattcaggactgtgtgccagcgctggccacaccaccaggaggcctggcctggcccgagagggatgccagcttggcatctcccacagggcagggcgtgttgggagccgctgttggctgggggctggcctgagcctgactgcctatgtggagctggcaaggagtgaagaccctgctgccagcacagggccgaggctctccggctaaggacaggcttaggacaggcctaggctctggggtcctcagccccctcccagcagggcccggcccatgctgccagacctgggatgtgcccctggacctccctacctcgggcctctgcccaccccagcctcctcccccagacccctcggtctctgcccctggaggaagccgggagtgtttcttttggaaatgaccccagtttgtggttgttctttgtagacacaccccctgctggggatgagaagtccccctggaccttggtttgggcgggaaaccggctgtgtcccacgttaacctaaatcgtcttttcctctttacgttccagagtcatgcttgaggccaggctcgaatcctgcctgcctttggtggctctgagattcagggctgtcttttctgagagcacccaagtgaggtgccttgggatgcccctgacttggagacacagaggaggctgggcaccccttttccccgacgcactgagccaggtcagcagaggtgctggggcctggcatggcccctgggaaagaacctgctttcctcttgtgggaagtcaaatcctcgcactcagtgccggcaccccttggcgggtgacaagagggcatctcgaaggccactgtgctatgggagttacggctttgactctgagacgggggcctgggtgaggacctggtatcctcaaagtccccgtggctgccctgtggagaagactctgttgggagagggcgctgcctcccagaagtgtcccaaggtccaggaaggaatggggggaagaggacaggagggtgttctcacagtcactgtgacctctggtgagcagagggtccttctcaagctactgaatcctcatggggcttgggtgagggagcgaggataggccaggagccagaggctcaggaggggatggcctcactgtggaaggtgcaggggtggtccagcctgagccctctgccccccgctgcagctcagcaccccccccccacgcacacttacccagggggttgcaaagtgatgggtgttggctctggaactagtcccatgttgtttcccagggaaggagccacacccttctcagacctctgggctgatgcacgaaacggcagccctgcctgggctgcccaccgcccgtcacagaacgatcccgctgcaaatttcacaggcatctggatcgaataacaggctgatagggcgtataaaattagagacagaactctccagaaggcagggtggaggctgcagctccctgggattccacgtgagaaggcagtgatgctgctgcccccacgggaaggacggatgctgagtcagtgggaagacagtgggaagcccagcctggaggggaacgggggacggggtggggggtggtccagaaaaagcagcaggcggttggggtgggacacagggactgtcccgcccggggaggcccccagaccaggagggccagaccctaccgcccctctgcaggaccccatccctgcttcactcccttgctcctagttctgagttgggcccagcctgagtctccaccaggtggacagtagctcctcggggcagctgggtgtgggatctgcaggctcaggcagccacccagatactagcggcctccctgccctccaaaagcccagcctgggatgaaccttgacaaaggccctagaccacagcaaccaccccaccagggctctgagttctccatgaggactggtttccctggaaggtgaacactcaggggctgggacccttaaggattgttcttctcaggtcttcaccgtttccagacgtgtgccttagacatctgcacggacatctcttcccagggatgggcgtctcagggcaggtgcatttaaacttgtgatagagactccaaatcacctctcaaaagcctgttcccattcacacccctgcatacggcatgtcagtggatcccttcctcactggagcaacactagatttagtcataaaatatttttcaatttcttatttctatgattaatagggaggttggatattttgtgatattcattagtttatttgactatgtttctgtttttaccctttaccacttttctagctagtcatttgcttttttcttgttgatttgtgggagttctttatatatgatgaatatcagtactttgtgtttacattgcagatattcgttcccagtctgctgcttattattttacctttttaaggttgttcttttcatcacataaaagtttttaaattttaagtagtcaaatggtttcctttaaggctttggattttgcatttttataccaaaatgctcttgtattttcttccaaactttataattattctttttttttttttttttttgcctttaagttcattttggggcatggggtgagacagaatagcaccatttttccacattaaatcttagatattgtgagccctggaggacacaaattacagcttagaggcctggagcatgattctggagccaggcttcctgggccggagtccacgtcctgcccatggtggctggccattgctttggggagcctctctgagcctcagtgtcctctttgaaagagtggttgttcagagtaagagggtatcttcctgtggacgactcagcttgcgtctcagcccacagtgagcgaagaaccagggggtctcacagagccctgactcaggcgctgagggtccccctaacctccaggcaattcggcctgcacccccacccccgcttcttcttgcctcttctagaagagaggagggtggcggtaaggctggaagggggaagaaaatctgtttcccaaagcctccaggtgattcagccagagtgagaccaaatggcttgggtcttgggttttcagcttcctcacctgtgcggtgcaggtgacagcaccccacttcctactctgtgggcaggtaacacctgcgtgctctgagaaggggaaaacatctccaccctccccagaggcctgcacggccggaggtcacagtgaggcggccacacgccccgggctcttgctccgaggggacgctgtcccaacaagaggccccctcacagtctgtcctgaccctggctctgtggcccctccttctccttgatcaggcccctcccgggtctaccgggatctctggctgccccccgaccccctgctgcagccccaaccctaggtctccacaaagacttcgggatgccccgtgagcccctgggtcctggacccctcttcctcctccagcccctcctctcccagctgctcctggctgccctttaattgctcagagctgttcagcaacctggcgcgtagctggtacataagtggctgttggttggagtcaagtgagtgatggggagatgctaagaagagtgaaagaagcctcggcacccgccgggagcaggtgctgggggtgtgagtgccgctgaatgaacgcgtcctgggacgggatcctgaagcccaccctcccgccgggcccccacaacccagagcgcacaccaaactttctacgtgtctttcccggtcagcctgagcccaaaccacccatgtccctgagcttgtccttgtctgaaagaggagggaagtgtctgtgtcctcaggagcccctggccttaaagataggcaccctggctctggcaggcaggtggcccctggcagcctcgcccacgcccgcggtgactagctctcgggcaagcgatgcaagtgcagaaaccagctctgtgtggtcagtgccccggagctgcagcggcagcagaggtcggaacaccttcctctgtgggcacgccacggaaatttaaagacacagggtgctctttcgcaaaccgggctcgttgattctacaggagaaggtaactattattgagtttcttctttttcagaatgagtggcatccaaacctgactcatatttccaactttattaatttttgcaagacttcggagggtgctctgtggcgattaatattgctgagctgagcacagctgcaatactttcctgtaaaactgactaaaggagaagttggtgtcttcctcatacaagaaatacataaatcagttaaaaatagttctccgagcggatatgatgatgtcgtggccgtcacaggaaacacatgaatcagcctcatcctcagttccagggaagtggggacagtcggtggtccttggacccctcttggggcgcgtgggtgaggcagggtccctctggctttacctcatacccggactggcaaagctgcctgggaggacaactaaaaccatgctcctttgattctgtggacattgctaattgctgggcgttcatttcttgaattcagaccttctcatgaaccagaggagctggctcagaaaaatgccggtgacgcatgggcctgaactggtcagtgcagctcagagatgctcgccgtgggggacgtgcagtttgcctgtgggccagttgtccacccgtcaccgttaccccgctgaggaagctgtgggtgccacccagagagcttgggtacaacacggtctctgctttactcataaaaagccaagacctatgtggtcatggagcgttaaaacagaaatttcacaccacgccgtacggtccccgaggccagggtgttggcacatttcacatccaggaggtgccgtcgctgtcactggctcagcaaagccagtgccgaagccactgcaactgcctgaggcccagcggtggctgggagccaattggtgtcactcggttaccacagggaaggagacgtggctgtagaggcttgtcgcaggtcacagagaagggacttttgggctccaggcctagtgggttcgagtcagcacggtgtcttccccgacaccaaacccaaggaccctcagcacttcctgacctcaggtttctatttctagggtggggagtagaggtgaagggaagcaaagtcagagttgaatataaagctccagaaaaactcagctcagaattgactagagggttgagagcctgagatccctaaggggacatgtcaacccagggcagccgctgagggagattgacatggtttccatggtccttccactgggctggggccctccctggggagtctgtgctgggctggaccttcttccctgccagtggcctctcctggctgggtggggagctccgggggagcagacggcaagagtcttgtttggaaacatgcccttcccaggaaatccccaaaacaaaacctgagaagatctcctggaagctcaaaagcaattttcttttcatatgtcgggccaataagagttaatttcacccagtttctatattttcatgggtccttagaagctttctgaccctgtgccctgagacttagggtctgatggctgaaggaaccttggtcccaggtccctctcctgtggaggggccgtcagagggagagaagagctcgccctggttcacttggcctgtcctgaaagagaaccaggagggagagcagcctagcatgggtgcacacaagcatatgtacaaacatgtgctagggcaactcacacacgtccacatgcatgcacatacacacatgcccacacccatgcacacttatgtgtgcacacagattcagactgtacctgtacacttccacacttccacatgcatgcacatacacacatgcccacacccatgcacacttgtgtgtgcacacacagattcagactgtacctgtacacttacttccacatgcatgcacatacatgtccacgcccatgcacacttgtatgtgcttgcacagattcacacgtgtacatgcacacacacattagcatgtccttgcatatgcacacatacacacatctgacttcacattacatacacacatgtacatgcacatacatgacacacatggctcgaactggaggggagggtcccagttgctcccctcgcctgaccatctagtaagtgttgtgccccatgctgccccatcctgggctcctggccaggctctaagattaactagagaggctctgtccctaagaaaggtcacgcacttcagggtaggtaaggtggacaggcaaggcctggtgacctcggcccatccttgtgcctccagaagccgtaactcacctcaaagaggttttcctgctggagggaactatctctgagcaacaggggcagacttcacagctcaggcgccctcctgaaggtaagaggcactgggctcgcctatcaaagacactctcctgtccccgcaggttcccctatgtcccatcagggagctgggctccaaagtctcccgccctgcttctcctagagaatgcaaaggctgcctctcttccctcccagtgtaacctgaccctcctctgtgccccttggccacccttgcatcctctagctccttctgacaccttctttttgactgttcacagagggcaggatctgaagcctgcagaggtgacccttggtgccttgtgcaaggctggccagcaagtaagcatgacttttggctctgctgccagctgggccatttgatctacacacacttttctgcctctacctggagttaggcgaggctctctatagaatgggtacttgtcaacaaagtgggcttagactccgggcagtagcagttgaggcaggagcagtgggagaagtctgggctaatggcaagcacccagtcccctctgtgagctgcccacttgtcccaggctctgccatggcccttcctctgatttttaggagctttcatgaggcctcgcacagcctgaaggagcagagcttgttgtgctaatccccagcatcctctgcagagttctcaacaccttgtggccgaaaggtccttcagattgtccaggcacccaccccgaaaaccagccctggcatgggggtgctgacccctcccggagcagtggggtgcagggctcataaggcggggtctgcaaagcatgctggggtcttgctctgtgcttactccaaggatgcagcccggagtgccactgctcttggactttccttgaggtgggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcctggctgtttagtttattcttaccagaattggatgtggacagtaccgtcctttacaaatgattcttatcaagtacataatgtgttcagtagcaattcttttcaacttctgttaaacttaatccacaagaggaatggtgggttctggtcactactaacagcaataaaacaaaaggactgccagactgcccaaaggaatctacaaagggaccttttctggtgaattcaattttatggaataattgtaatgccattattggcgggattgctccagccagaatacgacatgctcagagttcaattatttgttacaatattagaggacggatggcagtcctacaggttgagagaatgggtgtctccttacccattcaaatggatgaacacaggcattgttccttctagaccaaaaatgattcatcccattgttaccccagaacatcctgaattatggaaattagctgcagctatgacaggaataaggatatggagtgctacctatcaactctctcccactaatatcaaaacacccacattcaacatcaccttgatgtctgaacaggtgatacgtatcaggagctgtgtcaaacccccttacatgctgttggttggaaatataattatcattcccaatacacaaaatatagaatgtgataattgtaagctgttcatgtgcattgatgctacttttaatcccacaacaagtattctattcgtaagggctagggagggggtatggataccagtttctttacatcatccatgggagtcttccccctctatacacatagtcaatgaagttcttaaaggtatcctgaaaagaacaaagtgatttatttttactgttattgtagtcattgcaggtctaattgcggtttctgcaacagcggcaaccgctggagttgagatccacagttctgttcaaaccactcaatatgttgaagcatggcaaaaaaactcctccagactttggaattctcagactcaaattgatcaaaagttagctaatcaaattaattatctccaccaaagtgtaatatggctgggagatacagttatgaatttggaacaccgtatgcaattacaatgtgattggaatacttctgattactgtataacaccttatgcttataataaagatcagcatagctgggaaacggtctcaagacatttaaaaacctgggatgataaccttggatatttcaaaacttaaagaacaaatttttgaggcttcacaggctcatttatccactgttctgggctcagacatttttgaaggaatagctaaagaattatctgatcttaatccctttaaatggatcaaacccctcagaggatcattgttgtcactggcattattaatattggtatgcttatgttgtctacttttagtctgcagatcccgcaaggaatccgaagacaagtccaaagtcaacgacaagcaatgatggcaatggtgatcctagttaataaaaagcggggagatgtgggtggcaagccacccaggtgccgaggcaagagaccgagagcacgagctgttccagtgtaataaaatatataaaataacaagagttatactgatatagctcatagatatgattatatataaataccattaatcattagtttgtagtaattactctttattcaaatattataataatcctcactctacaatcataacctagaaaaaggcaggccatgcagagataggagctgaggggacatggtgagaagtgacaagaagacaagagtgtgagccttttgttatgcccaggcagggccaccagagggctccttggtctagcagtaatgccagcgtctgggaagatgcccgtaccaagcggaccatggtctagtggtagcgtcagtgccaaggaaaagcacctgctactgagcagaccaggaaagggagtctccctttccccaggggagtttagagaagactctactccaccatctcttatggagggcctgacataagtcaggcctgcctgcagttatccagaggcctgaccgtctccctgtgatgctgtgcttcagtagtcatgctcctggtctgctttcatgttccatcctgtacacctggctctgccttctagatagcaatagcagaattactgaaagtattaaaagtctctgaaatgcagaaataatggtgtaagctgtctctcctctctctccgcctcggctgccaaacagggaagggctccctttccagtggatgcatgacccacgtgaccttacctatcattggagatggctaacactccttaccctgcccccttgtcttgtatccaataaataacagcgcagcctggaatttggggccactactggtctccacgtcttggtggtagtggtcccccagccccagctgtcttttcttttatctctttgtcttttgtctttgtttctatgatctcttgtctccgcacacggggagaaaaacccacagaccctgtagggctggcccctacaggctctcaactgtgtctctgttcagccctgctgtagggctctcaaccttctgcctgtttggcctggcaatgaggccctcaaccctatccctccacagcctggttatccatctctcacttctgcttctcctttggtgcatcaggctccctcgaagcctgtcctgcagttactgcagcagccttgatttctcaaccctaaaagacctgcccagcaggtaatcgcacctcatcctggcttacaggttcttgattcttcctctatccaaaactcgaatctctttttggcttctggtccggttaccactgctgttgccaccaccatggctgctcataagcaacaggttacatacattcctgaaaatgacactcctcttatgagagccatttctcaagccagggagtatgggcatcctgaggcctagcaacttcctcttattctacatccccatatacctgccgctcctgttgctgtggcacaggatcagccacagcccgctgatcctgctcagcaggtggctgatcacacggctccccaaggtccgcagcctgaaaatcaggctcctcaggcaaataatcaggctcctcaacctataccataaatgcttgctgctgtagcgcagccagctccaggtatacctgcagtccaggcagtagtccaaccagatccttttcatccaggccaggtccagttactccctgctacacgggaaagtttttcttttaaattcctcaaagatttcaaagaatcagtgaaacaatacggcaccaactccccttttgtgcattccacattaaaagctctagcagaggataaacgtttggtgccttatgactggggaattctagcaaaatcagtattatctgaatcccaatatttataattcaggacttggtgggttgatgctgtccacgatcgagttcagcttaatcaaggctctaatcctcctgttaatattacagctgaccagttattgggaatgggacaatggcctgcaattacaaatcaaactatactaaatgatgaggtcattcaacagcttcgcaaatgctgcctatatactaatagtagtgcatttataccagtccctaacgatgacaggtttcccgctcaaccagaggaagaaggtatgcagtttaatttgtcaattggatataaatacccgccattgtgcataggaatgtcacctggctgcttagctttctctaatcaaaattggatatggactgtaccgtcctctaataatgattcttatcaagtacataatgagtttagtagtaattcttttcagatcatgactgttaaacttaatcctcatgaggaatggagagttcccgtcactaccaaacataatacaacaaaaggactgctagactgttcaagtgaacctaccagggaaccttttacagttgaaactattgtatggaatgattgtaatgctccaaaagcagtagtgttacagcgcctgattacaggtggttattgactgggcttcaagaggatattattggctaaatttttccagcctaaatgccaaatattctgagttcaactatttgatagattatgtagaggagggatggcagtcctacaggctgagggaatgggtgtctccttacccattcaaatggatggacaaagtgatcattcctcctagaccaaaagtgattcatcctattgttaccccagaacatcctgaattgtggaaattggctgctgccatgactggaattaggatatggaatgtaacctatcagatcactcccactaataccaagacagacgtatacaaagtcaccttgatgtctgaacaggtgatacctagcaggagctgtgtaaaatccccttatatgctattagtcggaaatataattatcaccccccaacagccaaaccatagaatttgatgattgcaaattgtttacatgtattcgtgttacatttcatcccataacaagtattctcctggtaagggctagggagggggtaaggataccgtttctttacaccacccttgggagtcttctccctctattcatatagtcaatgaaatccttaaaggaatccttaagagaacgaagagattcatctttactcttattgcagtcattgcaggattaattgctgtcactgccacagcaatggcagctggagttgctatccacaactctgttcagaccactcaatatgtggaagtgtggcaaaaaaacaaacaaacaaacaaaaactccaccagactctggaattctcaggctcaagttgatcaaatttggctaatcaaattaatgatctccaccagagtgtgatatggctgggagatagagttatgaatttgcaacaccgtatgcaattacaatgtgattggaataattctgattattgcataatgccttatgcttataaaaaagatcagcatagctgggaaaaagtcatgagacattcaaagcctgggatgataatctaacttaagatatttcaaaactgaaagagcaaattttgggggcctcacaggctcacttaactaccgttcctggctctcatatttttgaggaaatcaccaaagtattatccgatcttaatctttttaaacggatcaaaccccttagaggttcactattgtcactagcattactgatattggtgtgtttatgttgtctgcttttagtatgcagatgtcttcagggagtccgatgaaaagcccaaagtcaacaacaagcaatgatggcaatgatgatcctagtcaataaaaagaggggagatttgggcagctgtggacgaaggattacccaggtgccaagacaggagactgaaggcacaaactgtagcagtataataaagaaaatagttagaataaagaatacttacaatacaaattagatatagagatgatcatggacaattatcaatcaataatgtataaacattattaatcattagcttttaatattagtctttgttgcattactaatataacctaggaataattgatgggtgtaggatcatgtactgaagggacattgtgagaagtgacctagaaagcaagaggtgagccctctgtcatgcccacataagggccggttgagggctccttggccaagcagtaatgccagtgcctgggaaggcacccgttacttagcagaccaagaaagggagtctccctgttcttggaggagtcaggaaacactctgcttcaccacctccttgtgggaggctttatattatccaggcctgccctgcagtcatctggaggcctaaacccctccccgtggtgctgtgcttcagtggtcatgctccttgtccactttcatgttcctcctgtactcctggttcctctttgaagttcatagtagatagtggtagaagaaatagtgaaagtcttaaaatctttgaactttcttataagtgcctagaagaaaacactgatgtatgctgcctttcctctctgcttcagctacctaaaagggaagggccccctgtcccatgatcatgtgacttgcttgagcttatcaatcacttggacgtctcaccctccttactctgccccctttgtcttgtatgtaataaatatcagcgagcccagccattccgggcccctactggtctctgcgtcttggtggtaatggtcccctgggcccagctgttttctctttatctctttgtcttgtgtctttatctcttataatctctcatctccatacatgggtagaacacccactaaaccctgtagggctggaccctacaggcggcaagctacccaggtgctgaggcaagagaccgaaggcacaagatgttccagtataataaaatatatagaataagaatagttatactagaaatagaatacagatatgatcatatatgaatattaatcattagtttgtagatttactctttattccaatattataataatatctgttttacaattataacctagaaaaaattaggccatacagagataggagctgaaaggacacggtgagaagtgaccggaagacaagagtgtgagccctctgtcatgcccggacagggccactagagggctccttggtctagcggtaacgccagtgcctggggaggcacccgttacttagcagactggtctagtggtagcgccagtgcctgggaaggcacccgttacttagcagaccaggaaagggagagagttagagaagactctgctccacgacctcttgtggaagatctttgtcaggcccacccgcagccatgcccacagccatctggaggcctaaacgtctccctgtgatgctgtgcttcagtggtcacgctccttgttcattttcatgttccactctgtgcacctagcctggccttctagacagcggtagcagaattagtgaaagtattaaagtctttgatctttccgagaaatgcatagaagaaataatgacgtaagctgtcccctctctgtctccacctcagctaccaaatagggaagggcccctgtccagtggtcacgtgactcacgtgaccttacctatcattggagatgacctgcactccttaccctgcccccttgccttgtatacaataagtaacagcacagccaggcattcggggccactaccggtctccgcgtcttggtggtagtgttcacccgggcccagctgtcttttattctatctctttgttttgtgtctttatttctatgatctatcatctccacacacaagagaaaaccccaaaggccctgtagggttggaccctacatctggcgcccaacgagaatttctctctcgctgtgtgaagttgcactttgagcgtgaaacacagcagaggatttcaatgacagattcctgaggattgaggtcaataagcttggtggtaagcttgggcactcagagtatcccagggacaccaagggacaggcctgtactaagtactcagcttatttaaattttataaaaactctccttaaagaaggagtggttaaaagtatctactgataagttaattgaactgtttgatgttgtagatcttctttgcccttggtttcctactgagggaactttagaacttaaggattgggatgagattggcagacattcaaaattgctcataaaggcgggcatattattccacccccaatttggtcaatctgggcttcggttcgctctgtcctagactctttacagactcaggaggacaacatggagactgatccctctttcctctgaggaggctgaggaagtgcttagttctttttcacctgaggatactgcacagattgaggccatagttctacagatggacctccactctgatattcctttggtgccaccacctacgccagagcctaccatgccccagttatcgctttatgatgaacttttaactgatctgaatgaatttatttcccccaaccagcaaaatccagctgaaagatattatcaacagccatcacagctgtaccctcctacctttcctcaaactctcaactctccagctatgcagatagaaaatgagatgatgcagcctgaaaaagaggctctaaactatgttttcatgcagcctggtacagaggctccaatttctacacagcccggtgaagaggctctcaattccctgcctggtaatgaggccctgaaccctatccctgttcagccctgctgtagagctctcaacttcttgcctattcagcctggtaatgaggccctcaaccctatctctgttcagccccgctgtggggctctcaactttctaccagttcagcccagttatgaggccctcaaccctatccatattcaacctatttttccacctctctcttctcgttctcttttgacaagtcagtctcccttgaagcctggacctctcttggtaaatcaggctcccttgaagcctgggtctctttcagaaatcaggctcctttgaagcctgggtatcttttggcaaatcagtctccctcgaagcctgggtctctttcggcaaatcacacttccttgaagcctgggtcttttctgacaaatcaggctcccttgaaacctcaggctctcttgaagcctggtccacagttactgcggcagcctcaggcccatgaaagacctgcccagcaggtaatctcgtctcatcctggcctacaggttctcaactcttcctccattcaaaattccaacctttttcctgcttctggtccagttgctactgtggtggccaataccaccattgccgctcataagcaatgagctatatacatccctgaaaatgacactccttttatgagggctatagctcagacaagagaatatggggatcccgaagcctggcaatttcctgtaattttacaacctccaatacccgccgtcccagtggcacaaaatcagccacagcctgctgatccttctcagcaggcggctgatcccgcaacccgtcaagatcaacagcctgacaatcaggctgctcaggaaaataatcaggctccacaactgcctgccgctgagacacagccagttcctgatgttccagtagttcaggcagtagttcaacctgaccctatacatccaggccaggttcagctatgtcccgctacttaggaaagtttttttttcttttctttctttttttttttttttgagatggagtctcgctctgtctcccaggcatgcccggctaatttttttttttttttttttttttttttttttgtatttttagtagagacagactttcaccctgttagccaggatggtctcgatctcctgaccttgtgatccacctgcctgggcctcccaaagtgctgggattacaggagtgagccaccgcacctggccaagtttttcttttaaattcctcaaagatttcaaagaatctgtgaagcagtatggcaccaactccccttttgtccattccaaattaaaagccctagcagaaaataaacacttggtgccctatgactgggagattttagcagtcagtcttatctaaatcccaatatttacaattcaggacttggtgggttgatgctatccaggaatgcattcgtctttgggctctaatcctcctgttaatgttacagccgaccaattactgggaatgggccagtgggctgcaattcgaaaccaaactatactaaatgatgaggttattgaacaactgtggaaatgctgcttagatgcttgggacaagattcaagatgatgacaaactatgcccatgttttacagccgtcagacggggacaacatgaaccgtatccagactttattgcccatcttcaagacgcagcagaaaaagctatccctgatagccagggccaatgacttgttatagaacttatggcttatgaacaagtaaatccagactgtcaggtggctatttgccccattaaaggcaaaattccaccagggggtgatgtactcacctcatacattaaagtctgtgaaggcgtgaggggaactctgcgtacagcaatggtcatggcacaagccatggtctctattcgaatgcctggacaattccctggcaaatgcttcctatgcagccaatcgggatattctaaaagaaattgtccttggcatacaggccgctgttcttttcaacaccaacaaccaaaattttttcaacaacaagccccactttctactatatgcccacgatgccaaaaaggaaatcactgggtggctcaatgccattcaaaatttgatattgatggcaatcccttacggtcacttccaggtaaacgggaagaggggccagccctaggcccctccaaacaatggggcattcctcaactctgagcccctggcgtccagcaagatgagcgccttgccagcccaatccattcaacgtacatcccaattcccacttcagcaatttgtgccacaggatctaatggctctgccccaacacgaatctcagtacaatgcttgtcccctgccaccacaggctcagcatcagtagatctctgttgtaccagagatatttctctgttacctggagagccacctattgctgttcccacaggtgtttttggccccttgccgactggcagtgtcggtttgctatttgatctctcaagcctaaatttaaaaggtgttcaagtacatactggtgtaattgattctgactattcaggtgaaattcatattgtcattagctctgcagtcccttgatatacggcagctggagaccgcattgctcagcttcttatactcccttacgttcctttaggatccagttcttgtaccagaactggaggttttggtagcacagactatcaggacaaagcagcttattgagccagcaagatttctgacactcgtcctgtgtgctctgtgcatattcaaggaaggaagtttgagggaatgattgatacgggcgctgatgtctccattatcgctttacatcaatggccccgacactggccaaaggaacacgcgtccacagcattagttggtgttggtcaggcttcagaagtctatgaaagttctacaattttacactgtacgggcccagaagaacagattggtactatttgccccctcattacacccattcctgttaacctgtggggaagagaacttttacaacaacgaggggcacagatttcttttccacaaggcaattacagccagcaaagtaaagacattatgacaaaaatgggatttgttcaagttatgggcttagggaaatcagcacaaggcatcaccgagcctattatacctacccataaatcagattttacgggacttggttattctttttagaagtggtcactatcaagcctccaaatcccatccccttgacttggaaaactcagaaaccggtttgggtaaatcagtggccgctccctaaaaataagctggaggcactccatattttgatccttgaacagttaaaattgggacacatcgagcaatctttttctatctggaattcacctgtctttgttatccaaaagaaatccggtaagtggagaatgcttactgatcttagggcagtaagtgctgtccttcagcctatggggacattacaacccagcttgcctttccccgctatgattcccaagtattggcctcttatcatcattgatcttaaagactgcttcttcaacattcctctggcccctcaggactttgaaaaatttgctttcacagttccaacccttaacaacatcgctcccacagcacgttaccattggaaagtcctacctcagggaatgcttaatagcctaccatttgtcaatattacgtggggagcatattaaagccagtaagagatcaatttccccaattttttatcattcattacatggatgatattctttgtgcagtgccttcacgttctgtattaatatcttgtttctctgcagtacgacaagcagttgcaacagctggtttggctgtcgctccagaaaaaatccaaacttcttctccttatcaatatttaggaatgcagctagaagacaaggttattaagccccaaaaggttcaactcagatgagactctctaaaaacgctaaatgatttccaaaaaatgcttggagatattaattggatttgcccctccttaggcattcttacatatgctatgtctaatctgtttgcaacattatggggcaatcctgatttatgcaacaaaaggtctttgacccctgaggcagattctgaattacaacttatagaaaaacgcattcaacagtctcaggtaaccagggcgaatccatatttaccttttgaaatactaatctttcctactaaacattcaccaacaggactcattatccagggacataatttaattgaatagtgctttcttccacacagctctttacggacgcttaccgtttatctagatcaaatttctatcctaattggtcaagctctttctcaccttcttcatcttttgggtacagagccccaaaaaatcattgtttccctcacctgattacaagtccaacaggcttttgcaacctgcattgcttgccaagtacatttggcaggtttcctgggtataattgacaatcattatcctaatgtaaaactatttcagttccttaaacttacttcttggatcttacctaacattactatggatactccattagctgaagctgtcactgtttttactgatgcttcctgtaatgaccaaggagcatatgcagggccaaaagaatgtgtccttaactcaggagctacttcagcacaacaagctgagctgactgctgtcatggctgttcttgaatatttccctgaaccagttaacatagtttctgatttggtgtacgcagcaggtgttgcttgcaacattgaaactgccttaaacacatttctgcctgatgataaccactttttcttttccaaaagtttcagtccctactcagagcaaggtcttctcccttctacattactcacgttcgggctcacatgcccctccccgacctctctcagcagcaaatgccagcgctgatacattagttgctcccatttttatggacgtagaaaattttcacgctgtaactcaagtcaatgctgcgggactcggaaaaaagttctgcttcacatggaagcaagctaaaaccattgtatgtcactgtcctacttgccaagtgttaattttacatccactttcttcaggagttaaccctagaggactttcacaaaatattctctggcaaatggacgtgactcattatccagctttcagcaaactctcttttatgcatgtaactattgacactttttctcattttatctgggccacatgtcaaacgggggaaagtacggctcatgttaaacagcacatggtttcatgtttcttggttatgggatgtcctgagaaactaaaaactgacaattttctggttacattagcaatgattttaaaaagttcactcagacatggggaattactcacacaactggcattccctataactgtcaaggacaggcattggtagaacgagttaataaaatgctgaaagaccaactttgaaaacaggacactaaagagaagaaggatgctcctacccccatactcagttaaattttgttctttttacactcaatttcttaaacctagcaagaaatcaaccttttacagcagcagaacaacatttcactggaaacagatttgatccacaaaaaggaaagtgggtatggtggaaggatacaaaaactgacaaataggaattaggcactgtggtaacatggggtaggggtttcgcttgtgtttccccaggagaaggacaacaacccgtgtgggttccctcccatcaactgagattgcattttaactccaaggatgaagaactctcagaaacaaaaggcaaagaagcctcagaaatcaaagagcaagttttgccacctgacacataaattccatgacctcgacattacaacaaaatctcaccgtgtgacctccaacacaagtcattctactctaccaacatggggccagataaaggtcttatcccatcaaacagagaaataactacaagaaaaaggaattccaaaagtgacgggtaatataattctggctgcctttatggtggtcagtgcagtggtgagtataccaggggttggggcaactcaaaattatacctactgggcatacattacttttccccctttaattcggtctgtctcctggatggactcctcagtggaagtttacactaataatagtgtcttcatgccagtccccaatgatgacaggtttccagctcaaccagaagtaaaaggtatgcactttaatttgtcaattggctacaaatatccaccactgtgtattggaatgttgcctggctgcttagcttattcttatcagaattcgatgtggaccatacagtcctctagtaatgattcttatcaagtgcaggagcaattcttttcaactcatgaatgttaaacttaatccacatgaggaatggagagttcctgtcactactaaaagcaataaaacaaaaggattgccagactgctcaaaggaacctacaaagggacattttctactaaattcaattttatggaatgattgtaatgctccaaaggccgtagtgttccaaaatctagctatgggtgctgttattgactgggccccaagagggtattattggagaaattgctctggctaaaataccaaatgcttggagtttaattatttgttagattatgtaaaggactgatggcaattctacaggttgagggaatgggtgccccttatccattcaaatggaggaacacaggaatcgttcctcctagaccaaaaatgattcatcaaattgttacccctgaacatcctgaattagggaaattagctgcagccatgacaggaataaggatatggaacgctacctatcaaatctctcctactaataccaagacactcatattcaagatcaccttgatgtcaggacaggtgatacatatcaggagctgtgtcaaatccccttacatgctgctagttggaattataattattactcccaatacacaaactatagaatgtaatgattgtaacctgttcacgtgtatcgatgctacttttaatcccagaacaagtattcttttgataagggctaggaagggggtatggatataatttctttacatcatccatggaagtcttccccctctatacacatagtcagtgaacttcttaagggtatcctcaaaagaaccaagagattcatttttactcttattgcagtcattgcaggactaattgccattactgcaacagcgacaaccgttggagttgctatccacaactctgttcaaaccgctcaatatgtggaagcatggcaaaaaaaactccaccaaactctgaaattctcatgctcaagttgatcaaaaattggctaatcaaattaattatctccaccagagtgtaatctgactgggagatagagttatgaatctggaacaccatatgcaattacagtgcgattggaatacttctgattattgcataagaccttatgtttataataaagatcaacatagtggggaagaagtctcaagacatttaaaagcctgggatgataacttaaccttagatatttcaaaacctaaagaacacgtttttgaggcctcacaggctcatttaactactgctcctgccttgggcagttttgaaggaataactaaaggattatctgatcttaatccctttaaatggatcaaacccctcggaggatcatcgttgtcattggcattattaatactggtatgtttatgttgtctacttttagtctgcagatgtctccaaggaggccgaggacaagtcccaagtcaacgacaagcaatgatggcaatgatgatcctagtcaataaaaagtggggagatgtgggtggtaagccaccgacgtgccaaggcaagagacggagagcacgagctgttccagtataataaagaaaatatttagaataagaatagtcatactagaaatagaatatagataggattatatgtgattatatgtgaatattattaatcagtttgtaacattactctttattccaatataataatctctgttctacaattataacctaggaaaatctaggccatacagagataggagctgaaggaacatggtgagaagtgaccagaagacaagagtgtgagccctctgtcatgcccgggcagggccactaggagggctccttggtgaagcggtaacgccagtgtctgggaaggcatccgttacttagcagaccaggaaagggactctgcctttccctgcggagtaagagaagactctgctccaccacctcttgtggaaggcctgacattagtcagacccgcctgcaaccatgcctgcagacatccggaggcctaaacgtctccctgtgatgctgtgcttcagtggtcctggtccactttcattttccgctctgtgcacatggccccgccttctggatagcagcagcacaattagtgaaagtattagagtctttgatcttcccaagaaatgcaaagaagaaataatgacgtaagctctcccctctctgtctctgcctcggctaccaaacagggaagggccccctgtacagtggatgcatgactcgcgtgcccttacctatcattggacatgactcgcactccttaccctgtccccttgccttgtatacaataaataacagcgtagctaggccttcagggccactaccggtctccgagttttcgtggtagtgttcccgtgggcccagctgtcttttctactatctctttgtccggtgtttttatttccatgatctattgcctccgcacacaaacagaaaaacccacaggccctgtagggctgcaccctacagaaagccatccagatgccaaggcaagacactgaacgcagaagctgttcaaatataataaagaaaataggataaaagaaagttatatcagacataggatacagagatgattacatatggatattatcaattattagtttttagtattaatctttgttattataaccgaggaaaaaacaggccatacagagtaagaagtagaggggacaatgtgagaggtaaccagaagacaagagtatgagccccctgtcatgcccggataacggctgcttgagggctccatggtcttgtggtagtgcctcttcctcggaaggcacctgttatttagaaaactttggtctagcggtaatgccagtgcctgggaaggccctggttacttagcaggccttggtctagcggtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtacacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactccgggccactacctgtctgtctccgcgctttggtggcagtggtcccccgggcccagctgtctttcttcctatctctttgtcttctgtctttatctcttcgatctctcgtctccgcacacacacgaagagaaaacccacagacccggtaggggtggaccctacattatctcagctacaacataatcaagatattcacgtggactactgagtctttcggtgcccccttgctgttttagttttgtcctgcggccgagtgtttccctcgcttcacgccaacccaatctccgccgccctgtcttgtcatccccattctacagcccagcacggtgtagtatggcagccgctagccacaggtatctagggagccctggaaatgtggtcagttctaatggagctgcgctgttaagtgtgaaatacacatgggattttgacggcagtgggagcaaaattctcccaatttttttttttttttttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttggtcaggctggtctccaactcccgacctccggtgatctgcccagctgccgcctcccaaagtgttgcttgcgattacaggcttgagccaccgctcaccctggctttttttttttttttttttttttttttttttttttcagacaaactctcgctctgtcgcccaggctggagtgcagtggcgcgatctcggctcactgcagcctctacctcccgggttccagcgattctcctgcctcagcctcctgggtagctgggattacaggcgcaggccaccacgcccggctaatttttgtatttttagggggtttcgccatgtcggccaggctggtctcgagctcctgacctcaggcgatccgcccgcctcggcctcccaaagcgctgggattacaggcgtaagccaccgcgccgggctctttcattctgtctttattttctgagatagagtctcgctcggacgctcaggttggactgcaacggcgtgatctcggctcgctgaaacttccgcctcccgggttcaagcgattctcctgtctcagcctcccgagtagctgggattattgacgggcagcaccacgcccggctactttttgtggtttttgtatgttctgtcttctgctctttagtaccgcatagagccgcagaagactagcgagtcgaacaaacggcccctcttgcagcagttgttgatcacggggctgccccccggtactcatcctgtgtctctcgtccaaatccccgctcctcctcagctatcacctctgccgatgctagtggtttccctgggtaccgggaaccaaactctcattccccaggggcctaagccccccgtggccaggcccttctcaagtcagggttcctgcacattcacagttacgggtggccctgggagtaacacctggcacccaaacaggtcaccagagtccacacatagtccacctgccctccctgcgtaagatcagctcttcctcctcccgacgatagatcagggtcaatgatccctgccaagatggcgactgctccagcctgctggtccaacctgtccagccacagctgttgctcgaaggcttgaagttcaatgggaccctctcccgctttctacaaactggttcctttatttttatgtttatttatttgggacggggtctggctctgtcacccaggctggagtgcagtggtgcaatcactgctcactgcagcatccacctcccagcgtccacccatcctcctggcctcagcctccggaacagctggggtacaggtacgccccagcccgaacaggttttcactaggttgcctgggctctttctttctttgtctgtgtttgtttgttggttggttggttggtttttgtttgtttgtttcgagacggggctccggctctgccgccgggggctgcagtgcaatggcgcgatctcacctcactgcggccttctgggctcaagcgatcctcccactgtgcccggcctgaagacagcctttagagaaagaagcagggggagttcttccgaggacagacaagatttctggagtttggaaagggtgagagactgggtcagcgaaaggaacattccggtctttatgttgggatgcaacgtatagatacagggatgagacccaaaagagccggcagaggtttgtcatcgtgctcgcaaggcaactgccggtggctgatcccgtaaaggatacacatacctagagcggagcctaaagatgcatccagcatgacgggtggagccacgatgcttggactcgagctctgctcctgtgcgttccgtgatcaatggcttatactacctgcacctcagtttttcccgggcaaaaaaggaagcttgctgccggtgcgttggcacctgccttaaagtgccagctactcagcgggctgaagaggaagaagttcctactaggaagacacgtggacacgtatgtttactgcagcactatttacaatagcaaagacttggaaccaactcgaatgcccatgaatgataggctggataaagaaagtgtggcacgtatacagcatggaattactacgcagccataaaaaaggatgagttcatgacctctgcgggaacgtggatgaagctggaaggcctcattctcagcaaactgacacaggaagcgaaaaccaaacaccgcatgttctcgctcctaagtgggagttgaacagcgagaacacatgggacacagggaggggaacatcacacgccgggccctgacggggcgtggggggcaaggggagagagagcattaggacaaatagccaacgcatgcggggcttcaaacctagacgactggtggataggtgcagcaaagcaccgtggcacacgtgtacctatgttccaaacctgcacgtcctgcacatgtaccccagaacttgggagggggtgggggaaaccaaaagagagagcgagggagaggcggggagggggggggaaagagagagagagacagagagaggagagagagagagagagagagagagacagagagacagagacagacacagagagacggagagacagagagagagagagaaagagagagagagagagagagagagagagagagagagacaggagaaagaagaactccgggtgggtcccattcctttaaaaggtcgccacccactcgactgccaagctgagatcctaaggacctccccaaaggaggaggtcgtggccttcccaaagcgcagtagccacggtggaaacgaaagcgtgccgcataagcctaccgtctaccgcccgcacatcaggaacctcacggtacttcagggaagcagttaagtcaagccggcgcgtcacaggcactcggcgtgcaagccgccccgcaggtgctaccgtctctcacctccctctacttttaggaaacacgttgtatccccggagggggtgcaccgttcctggaggtactgcaacaccaggtcgatgcgtggagtggacggagcaagctcctattccatctccctgctccaaaaatccatttaatatattgtcctcggatagaggacgtatcagatattaaactgataagaacagatactacacttgatcttagccgaaaggccgagaagcgatgcgctcgccttcgcgcccgccgtcaccgtcccactctcatccacattcaagtcgcggtgagagccccagcctcgctccttgccccattccctctgtctcgtccacagcgctattgacgcccttacactctcgggctgatttcttattctccgcctttgaaaagggaaatcttacacccgtgcttcttccggcgttcccgggctttcatttcgaatttgcatgccccgccctttcacagagggcgtggcctccgccgttgactccgcccccggggccgcctctgcctgggggagccggggctccgctgggggcgacttccttgttcgtatcgagccagcgaaaagacagaaccggaagagaccgggggcgaaggcgacaggggtctgtggaagagacctgtcggcggagagcggtccacgttttcctggagaaagacgaggccccagggcaggagcgcgggctgcgctgggcctttacttcgccgcccgcgggcggggagaccggccccgtacccgaggggacgaggggacgaggggcccatgcccagtcagggaagccgaaggcctggaggggcttccgggagcaggggctggagttcctctgccaggcaggaggctggcaccagacacccggcagagggaggcggcgagggcccagcaaggattctccccagcccctgtgcctgcgtctcctgcggcttctgtgcgcggaccgtgtcctgggctgtgtagggaacgctgcctctctgctcgggacgtggattcctttcccctcctcctcgcctggctacttctgacgcaggtcgtcaggactccgcttgggtgtcacccgtgcaggaagcctcccttagtcaagggccctcggcacccgccccatatgtgactagcagccctcctgtgtatttcatcgcgcccccgttgtttatatcagctattccactcaccacccttctgggcaaccctttatctcccgctctgaaatcccatcgctgagggctgggacccctcctcagtgcttatccctgtttccccgcgcgagtctggcgcctggcgtgtggaaggcgctcagtaaacgtttgtggagcgaagaaacgacgcaaaggtgatgagcacgacgcagttaggaggctattggcccggcgcgggggaaaagggggaaggtcgggctcggggtggcaggaccccagagggcaggggtgactgccggggtgctcttggggcaaggtgggcgtcaaggcccccagcaaggttgggataaagtttctctccgaggcacagactgccgcctgcgggctcagcatttacctctcccttcctccttcctaacgcaacttcagcggagggctgagggctctactgcgcattacctggaaaacttatttcactccacggccctaagaggtgggccttattattagccacggccagggttagggtgaggccactcctccagggcagaatttcagggggtgcccacccccccgccctaaatcattcagcaatcaacataaattatagttcaacgcaatatatcttatcttgtgggccgcaagccacccaggtgcccaggcaagagcctgaaggcacaagctgttccagtacagcaaagaaaataattagaataagaaaagttttactagagataggaaacggataggattatatctgaccattattaatcattagtttgtagcatcactctttgttctattaccataatgatctctgttctattatgattaccttgggggaaaccaggccacacagagttaggagctgaagggccacagtgagaggtgaccagaagacgagagtgtgagccctcattcacgcccagagaagggccgctggagggctccttggcctagcggtaatgccagtgcctgggaaggccctggttacttagcaggccttggtctagcggtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtgcacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtcctgcggccgagtgtttccctcgcttcacgccaacacaatctccgccgccctgtcttgtcatccccattctacagcccagcacggtgtagtatggcagccgctagccacaggtatccagggagccctggaaatgtggtcagttctaatggagctgtgctgtaagtgtgaaatacacatgggattttgacggcagtgggagcaaaattctcccaattctttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttggtcaggctggtctccaactcccgacctccggtgatctgcccagctgccgcctcccaaagtgttgcttgcgattacaggcttgagccaccgctcaccctggcttttttttttttttttttttttttttttttcagacaaactctcgctctgtcgcccaggctggagtgcagtggcgcgatctcggctcactgcagcctctacctcccgggttccagcgattctcctgcctcagcctcctgggtagctgggattacaggcgcaggccaccacgcccggctaatttttgtatttttagggggtttcgccatgtcggccaggctggtctcgagctcctgacctcaggcgatccgcccgcctcggcctcccaaagcgctgggattacaggcgtaagccaccgcgccgggctctttcattctgtctttattttctgagatagagtctcgctcggacgctcaggttggactgcaacggcgtgatctcggctcgctgaaacttccgcctcccgggttcaagcgattctcctgtctcagcctcccgagtagctgggattattgacgggcagcaccacgcccggctactttttgtggtttttgtatgttctgtcttctgctctttagtaccgcatagagccgcagaagactagcgagtcgaacaaacggcccctcttgcagcagttgttgatcacggggctgccccccggtactcatcctgtgtctctcgtccaaatccccgctcctcctcagctatcacctctgccgatgctggtggtttccctgggtaccgggaaccaaactctcattccccaggggcctaagccccccgtggccaggcccttctcaagtcagggttcctgcacattcacagttacgggtggccctgggagtaacacctggcacccaaacaggtcaccagagtccacacatagtccacctgccctccctgcgtaagataagctcttcctcctcccgacgatagatcagggtcaatgatccctgccaagatggcgactgctccagcctgctggtccaacctgtccagccacagctgttgctcgaaggcttgaagttcaatgggaccctctcccgctttctacaaactggttcctttatttttatgtttatttatttgggacggggtctggctctgtcacccaggctggagtgcagtggtgcaatcactgctcactgcagcatccacctcccagcgtccacccatcctcctggcctcagcctccggaacagctggggtacaggtacgtccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggattcggcctttggctacatcagtgtaatgtctgttcttgtagtttctctgacatgcccggcctcccgagggatgtcgccgagcactcgctggatattcgggccggagcccgacccgacctggatcctctgcgccgattcgacgaggagaagcgcagagcgatagcgcgaggagatccaccagctaatggcagccgggttcatcaaagaggtattccatccgcgaatggcttgccaaccctgtgcttgtgatagagaaacgggggaaatggtggatgtgtgtagactacactggtctcaacaaagcatgtccgaaggttccctaccctctgcctcacagcgagctaatcgtggattccactgctgggtgcgagaccctggctttcctcgacgcctactcggggtaccaccaaatcaggatgagagagtccgaccagctcgcgacttctttcatcacgcccttcggcatgtactgctatgtcaccatgccgctcggtttgaggaatgtgggcgcgacgtaccagcggtgcatgaaccatgtgttcggcgaacacatcggtcgcacagtcgaggcctacgtcgatgacatcgtagtcaagacgaggaaagctttcgacctcctctccgaccttgaagtgacattccgatgtctcaaggcgaaaggcgtcaagctcaatcccgagaagtgtgtcttcggggtgccccggggcctgctcttgggttcatcgtctccgagtggggcatcgaagccaacccggagaagatcgcagccatcaccagcatgggtccccatcaggactttaagggcgtacagagggtcatgggatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactcatgtggtggattctatctatcaccttgtcctcacgagtgggagataattgacaccaccctctttggtggtgagacctctactattgatcctctgcctaacaagcatacatcctggtatattaagcgtgtgactagctgactctcttccgtgcccacttgatgctgcaggattatactgtcttgtagtgtgtgtcttctgttgccgccaaggcctcaatacacaccctgccctgtgcttgtacatcttgcctctcctttcctcttgattatggtatctcgcactttcttctggctatccacaggagatgttggaaatgagcgacagtctcttctcgctgagctggacgagtgaagtatccatgtcatttagacgggggagtgagtaaaattctcccgactcgccgcttacgcgcactttcacccgaccatgaggtccctgtcttctactcagtccagaaggctcgaaggatcacttcggctcaatagcttcccaacctcaagacttgttcggaccccccaatcactttatcccaatgcgagttacttatcacagaaggtgatgagtgaggtatccgtatccctgatgcgtacgaatccctcttctccgtcagccttggctgc

SEQ ID NO: 669 - DNA, 294958 bp, Homo sapiens
  misc_feature (636)..(735): n is a, c, g, or t
  misc_feature (819)..(819): n is a, c, g, or t
  misc_feature (823)..(823): n is a, c, g, or t
  misc_feature (830)..(830): n is a, c, g, or t
  misc_feature (878)..(878): n is a, c, g, or t
  misc_feature (889)..(889): n is a, c, g, or t
  misc_feature (896)..(896): n is a, c, g, or t
  misc_feature (917)..(917): n is a, c, g, or t
  misc_feature (939)..(939): n is a, c, g, or t
  misc_feature (958)..(958): n is a, c, g, or t
  misc_feature (978)..(978): n is a, c, g, or t
  misc_feature (982)..(982): n is a, c, g, or t
  misc_feature (1123)..(1123): n is a, c, g, or t
  misc_feature (1129)..(1129): n is a, c, g, or t
  misc_feature (1911)..(1911): n is a, c, g, or t
  misc_feature (1988)..(1988): n is a, c, g, or t
  misc_feature (2440)..(2440): n is a, c, g, or t
  misc_feature (2898)..(2898): n is a, c, g, or t
  misc_feature (2902)..(2902): n is a, c, g, or t
  misc_feature (2907)..(2907): n is a, c, g, or t
  misc_feature (2996)..(2996): n is a, c, g, or t
  misc_feature (3095)..(3095): n is a, c, g, or t
  misc_feature (3131)..(3131): n is a, c, g, or t
  misc_feature (3140)..(3140): n is a, c, g, or t
  misc_feature (3223)..(3223): n is a, c, g, or t
  misc_feature (3226)..(3226): n is a, c, g, or t
  misc_feature (3229)..(3229): n is a, c, g, or t
  misc_feature (3266)..(3266): n is a, c, g, or t
  misc_feature (3478)..(3478): n is a, c, g, or t
  misc_feature (3521)..(3521): n is a, c, g, or t
  misc_feature (3552)..(3552): n is a, c, g, or t
  misc_feature (3811)..(3811): n is a, c, g, or t
  misc_feature (4093)..(4093): n is a, c, g, or t
  misc_feature (4202)..(4202): n is a, c, g, or t
  misc_feature (4258)..(4258): n is a, c, g, or t
  misc_feature (4366)..(4366): n is a, c, g, or t
  misc_feature (4569)..(4569): n is a, c, g, or t
  misc_feature (4578)..(4578): n is a, c, g, or t
  misc_feature (4585)..(4585): n is a, c, g, or t
  misc_feature (4695)..(4695): n is a, c, g, or t
  misc_feature (4730)..(4730): n is a, c, g, or t
  misc_feature (4733)..(4733): n is a, c, g, or t
  misc_feature (4761)..(4761): n is a, c, g, or t
  misc_feature (4962)..(4962): n is a, c, g, or t
  misc_feature (5060)..(5060): n is a, c, g, or t
  misc_feature (5226)..(5226): n is a, c, g, or t
  misc_feature (5403)..(5403): n is a, c, g, or t
  misc_feature (5449)..(5449): n is a, c, g, or t
  misc_feature (5491)..(5491): n is a, c, g, or t
  misc_feature (5930)..(5930): n is a, c, g, or t
  misc_feature (6578)..(6578): n is a, c, g, or t
  misc_feature (6760)..(6760): n is a, c, g, or t
  misc_feature (7171)..(7171): n is a, c, g, or t
  misc_feature (7209)..(7209): n is a, c, g, or t
  misc_feature (7223)..(7223): n is a, c, g, or t
  misc_feature (7260)..(7260): n is a, c, g, or t
  misc_feature (7277)..(7277): n is a, c, g, or t
  misc_feature (7319)..(7319): n is a, c, g, or t
  misc_feature (7330)..(7330): n is a, c, g, or t
  misc_feature (7332)..(7332): n is a, c, g, or t
  misc_feature (7335)..(7337): n is a, c, g, or t
  misc_feature (7340)..(7351): n is a, c, g, or t
  misc_feature (7353)..(7355): n is a, c, g, or t
  misc_feature (7357)..(7364): n is a, c, g, or t
  misc_feature (7372)..(7372): n is a, c, g, or t
  misc_feature (7390)..(7390): n is a, c, g, or t
  misc_feature (7396)..(7396): n is a, c, g, or t
  misc_feature (7399)..(7399): n is a, c, g, or t
  misc_feature (7401)..(7401): n is a, c, g, or t
  misc_feature (7413)..(7413): n is a, c, g, or t
  misc_feature (7432)..(7432): n is a, c, g, or t
  misc_feature (7435)..(7435): n is a, c, g, or t
  misc_feature (7442)..(7442): n is a, c, g, or t
  misc_feature (7448)..(7448): n is a, c, g, or t
  misc_feature (7453)..(7454): n is a, c, g, or t
  misc_feature (7484)..(7484): n is a, c, g, or t
  misc_feature (7577)..(7579): n is a, c, g, or t
  misc_feature (7581)..(7582): n is a, c, g, or t
  misc_feature (7584)..(7586): n is a, c, g, or t
  misc_feature (7588)..(7590): n is a, c, g, or t
  misc_feature (7592)..(7603): n is a, c, g, or t
  misc_feature (7605)..(7605): n is a, c, g, or t
  misc_feature (7633)..(7633): n is a, c, g, or t
  misc_feature (7654)..(7654): n is a, c, g, or t
  misc_feature (7663)..(7663): n is a, c, g, or t
  misc_feature (7805)..(7805): n is a, c, g, or t
  misc_feature (7810)..(7810): n is a, c, g, or t
  misc_feature (7820)..(7820): n is a, c, g, or t
  misc_feature (7822)..(7822): n is a, c, g, or t
  misc_feature (7825)..(7825): n is a, c, g, or t
  misc_feature (7828)..(7828): n is a, c, g, or t
  misc_feature (7830)..(7830): n is a, c, g, or t
  misc_feature (7847)..(7847): n is a, c, g, or t
  misc_feature (8280)..(8280): n is a, c, g, or t
  misc_feature (8424)..(8424): n is a, c, g, or t
  misc_feature (8449)..(8449): n is a, c, g, or t
  misc_feature (8576)..(8576): n is a, c, g, or t
  misc_feature (8696)..(8696): n is a, c, g, or t
  misc_feature (8921)..(8921): n is a, c, g, or t
  misc_feature (8971)..(8971): n is a, c, g, or t
  misc_feature (8989)..(8989): n is a, c, g, or t
  misc_feature (9013)..(9013): n is a, c, g, or t
  misc_feature (9016)..(9016): n is a, c, g, or t
  misc_feature (9018)..(9018): n is a, c, g, or t
  misc_feature (9402)..(9402): n is a, c, g, or t
  misc_feature (9740)..(9740): n is a, c, g, or t
  misc_feature (9786)..(9786): n is a, c, g, or t
  misc_feature (9791)..(9791): n is a, c, g, or t
  misc_feature (10116)..(10116): n is a, c, g, or t
  misc_feature (10256)..(10256): n is a, c, g, or t
  misc_feature (10266)..(10266): n is a, c, g, or t
  misc_feature (10268)..(10268): n is a, c, g, or t
  misc_feature (10270)..(10270): n is a, c, g, or t
  misc_feature (10277)..(10277): n is a, c, g, or t
  misc_feature (10575)..(10575): n is a, c, g, or t
  misc_feature (10644)..(10644): n is a, c, g, or t
  misc_feature (10654)..(10654): n is a, c, g, or t
  misc_feature (10661)..(10661): n is a, c, g, or t
  misc_feature (10712)..(10712): n is a, c, g, or t
  misc_feature (10849)..(10849): n is a, c, g, or t
  misc_feature (10858)..(10858): n is a, c, g, or t
  misc_feature (10869)..(10869): n is a, c, g, or t
  misc_feature (10887)..(10887): n is a, c, g, or t
  misc_feature (10905)..(10905): n is a, c, g, or t
  misc_feature (10923)..(10923): n is a, c, g, or t
  misc_feature (10966)..(10966): n is a, c, g, or t
  misc_feature (11014)..(11014): n is a, c, g, or t
  misc_feature (11066)..(11066): n is a, c, g, or t
  misc_feature (11133)..(11133): n is a, c, g, or t
  misc_feature (11369)..(11369): n is a, c, g, or t
  misc_feature (11539)..(11539): n is a, c, g, or t
  misc_feature (11575)..(11575): n is a, c, g, or t
  misc_feature (11577)..(11577): n is a, c, g, or t
  misc_feature (12001)..(12001): n is a, c, g, or t
  misc_feature (12045)..(12045): n is a, c, g, or t
  misc_feature (12083)..(12083): n is a, c, g, or t
  misc_feature (12163)..(12163): n is a, c, g, or t
  misc_feature (12264)..(12264): n is a, c, g, or t
  misc_feature (12395)..(12395): n is a, c, g, or t
  misc_feature (12815)..(12815): n is a, c, g, or t
  misc_feature (13002)..(13002): n is a, c, g, or t
  misc_feature (13118)..(13118): n is a, c, g, or t
  misc_feature (13120)..(13120): n is a, c, g, or t
  misc_feature (13147)..(13147): n is a, c, g, or t
  misc_feature (13175)..(13175): n is a, c, g, or t
  misc_feature (13187)..(13188): n is a, c, g, or t
  misc_feature (13844)..(13844): n is a, c, g, or t
  misc_feature (14001)..(14001): n is a, c, g, or t
  misc_feature (14004)..(14004): n is a, c, g, or t
  misc_feature (14013)..(14013): n is a, c, g, or t
  misc_feature (14041)..(14041): n is a, c, g, or t
  misc_feature (14158)..(14158): n is a, c, g, or t
  misc_feature (14565)..(14565): n is a, c, g, or t
  misc_feature (14608)..(14608): n is a, c, g, or t
  misc_feature (14687)..(14687): n is a, c, g, or t
  misc_feature (14902)..(14902): n is a, c, g, or t
  misc_feature (14908)..(14908): n is a, c, g, or t
  misc_feature (14977)..(14977): n is a, c, g, or t
  misc_feature (15034)..(15034): n is a, c, g, or t
  misc_feature (15105)..(15105): n is a, c, g, or t
  misc_feature (15912)..(15912): n is a, c, g, or t
  misc_feature (16163)..(16163): n is a, c, g, or t
  misc_feature (16403)..(16403): n is a, c, g, or t
  misc_feature (16463)..(16463): n is a, c, g, or t
  misc_feature (16540)..(16546): n is a, c, g, or t
  misc_feature (16548)..(16556): n is a, c, g, or t
  misc_feature (16558)..(16558): n is a, c, g, or t
  misc_feature (16560)..(16563): n is a, c, g, or t
  misc_feature (16565)..(16572): n is a, c, g, or t
  misc_feature (16574)..(16574): n is a, c, g, or t
  misc_feature (16576)..(16576): n is a, c, g, or t
  misc_feature (16578)..(16582): n is a, c, g, or t
  misc_feature (16585)..(16585): n is a, c, g, or t
  misc_feature (16587)..(16587): n is a, c, g, or t
  misc_feature (16589)..(16590): n is a, c, g, or t
  misc_feature (16606)..(16606): n is a, c, g, or t
  misc_feature (16610)..(16610): n is a, c, g, or t
  misc_feature (16622)..(16622): n is a, c, g, or t
  misc_feature (16640)..(16640): n is a, c, g, or t
  misc_feature (16679)..(16685): n is a, c, g, or t
  misc_feature (16688)..(16688): n is a, c, g, or t
  misc_feature (16692)..(16695): n is a, c, g, or t
  misc_feature (16703)..(16703): n is a, c, g, or t
  misc_feature (16707)..(16707): n is a, c, g, or t
  misc_feature (16715)..(16715): n is a, c, g, or t
  misc_feature (16719)..(16719): n is a, c, g, or t
  misc_feature (16727)..(16727): n is a, c, g, or t
  misc_feature (16737)..(16737): n is a, c, g, or t
  misc_feature (16742)..(16743): n is a, c, g, or t
  misc_feature (16746)..(16746): n is a, c, g, or t
  misc_feature (16751)..(16751): n is a, c, g, or t
  misc_feature (16756)..(16756): n is a, c, g, or t
  misc_feature (16774)..(16774): n is a, c, g, or t
  misc_feature (16785)..(16785): n is a, c, g, or t
  misc_feature (16797)..(16797): n is a, c, g, or t
  misc_feature (16889)..(16889): n is a, c, g, or t
  misc_feature (17124)..(17124): n is a, c, g, or t
  misc_feature (17576)..(17576): n is a, c, g, or t
  misc_feature (17590)..(17590): n is a, c, g, or t
  misc_feature (17676)..(17676): n is a, c, g, or t
  misc_feature (17843)..(17843): n is a, c, g, or t
  misc_feature (17849)..(17849): n is a, c, g, or t
  misc_feature (18008)..(18008): n is a, c, g, or t
  misc_feature (18014)..(18014): n is a, c, g, or t
  misc_feature (18023)..(18023): n is a, c, g, or t
  misc_feature (18152)..(18152): n is a, c, g, or t
  misc_feature (18568)..(18568): n is a, c, g, or t
  misc_feature (18574)..(18574): n is a, c, g, or t
  misc_feature (18612)..(18612): n is a, c, g, or t
  misc_feature (18642)..(18642): n is a, c, g, or t
  misc_feature (18670)..(18670): n is a, c, g, or t
  misc_feature (19421)..(19421): n is a, c, g, or t
  misc_feature (19507)..(19507): n is a, c, g, or t
  misc_feature (19584)..(19584): n is a, c, g, or t
  misc_feature (19604)..(19604): n is a, c, g, or t
  misc_feature (19671)..(19671): n is a, c, g, or t
  misc_feature (19893)..(19893): n is a, c, g, or t
  misc_feature (20003)..(20003): n is a, c, g, or t
  misc_feature (20025)..(20025): n is a, c, g, or t
  misc_feature (20054)..(20054): n is a, c, g, or t
  misc_feature (20378)..(20378): n is a, c, g, or t
  misc_feature (20675)..(20675): n is a, c, g, or t
  misc_feature (21059)..(21059): n is a, c, g, or t
  misc_feature (21127)..(21127): n is a, c, g, or t
  misc_feature (21367)..(21367): n is a, c, g, or t
  misc_feature (21371)..(21371): n is a, c, g, or t
  misc_feature (21615)..(21615): n is a, c, g, or t
  misc_feature (21627)..(21627): n is a, c, g, or t
  misc_feature (21808)..(21808): n is a, c, g, or t
  misc_feature (22050)..(22050): n is a, c, g, or t
  misc_feature (22091)..(22091): n is a, c, g, or t
  misc_feature (22093)..(22093): n is a, c, g, or t
  misc_feature (22102)..(22102): n is a, c, g, or t
  misc_feature (22120)..(22120): n is a, c, g, or t
  misc_feature (22148)..(22148): n is a, c, g, or t
  misc_feature (22315)..(22315): n is a, c, g, or t
  misc_feature (22396)..(22396): n is a, c, g, or t
  misc_feature (22560)..(22560): n is a, c, g, or t
  misc_feature (22594)..(22594): n is a, c, g, or t
  misc_feature (22604)..(22604): n is a, c, g, or t
  misc_feature (22777)..(22777): n is a, c, g, or t
  misc_feature (23039)..(23039): n is a, c, g, or t
  misc_feature (23237)..(23237): n is a, c, g, or t
  misc_feature (23253)..(23253): n is a, c, g, or t
  misc_feature (23256)..(23256): n is a, c, g, or t
  misc_feature (23260)..(23260): n is a, c, g, or t
  misc_feature (23263)..(23263): n is a, c, g, or t
  misc_feature (23382)..(23382): n is a, c, g, or t
  misc_feature (23418)..(23418): n is a, c, g, or t
  misc_feature (23425)..(23425): n is a, c, g, or t
  misc_feature (23498)..(23498): n is a, c, g, or t
  misc_feature (23596)..(23596): n is a, c, g, or t
  misc_feature (23602)..(23602): n is a, c, g, or t
  misc_feature (23612)..(23612): n is a, c, g, or t
  misc_feature (23664)..(23664): n is a, c, g, or t
  misc_feature (23727)..(23727): n is a, c, g, or t
  misc_feature (23767)..(23767): n is a, c, g, or t
  misc_feature (23933)..(23933): n is a, c, g, or t
  misc_feature (23959)..(23959): n is a, c, g, or t
  misc_feature (23973)..(23973): n is a, c, g, or t
  misc_feature (23981)..(23981): n is a, c, g, or t
  misc_feature (24307)..(24307): n is a, c, g, or t
  misc_feature (24625)..(24625): n is a, c, g, or t
  misc_feature (24631)..(24631): n is a, c, g, or t
  misc_feature (24638)..(24638): n is a, c, g, or t
  misc_feature (24802)..(24802): n is a, c, g, or t
  misc_feature (24804)..(24804): n is a, c, g, or t
  misc_feature (24835)..(24835): n is a, c, g, or t
  misc_feature (24837)..(24837): n is a, c, g, or t
  misc_feature (25481)..(25481): n is a, c, g, or t
  misc_feature (25499)..(25499): n is a, c, g, or t
  misc_feature (25707)..(25707): n is a, c, g, or t
  misc_feature (25738)..(25738): n is a, c, g, or t
  misc_feature (25836)..(25836): n is a, c, g, or t
  misc_feature (26048)..(26048): n is a, c, g, or t
  misc_feature (26050)..(26052): n is a, c, g, or t
  misc_feature (26054)..(26055): n is a, c, g, or t
  misc_feature (26465)..(26465): n is a, c, g, or t
  misc_feature (26699)..(26699): n is a, c, g, or t
  misc_feature (26963)..(26963): n is a, c, g, or t
  misc_feature (26978)..(26978): n is a, c, g, or t
  misc_feature (27050)..(27050): n is a, c, g, or t
  misc_feature (27057)..(27057): n is a, c, g, or t
  misc_feature (27239)..(27239): n is a, c, g, or t
  misc_feature (27336)..(27336): n is a, c, g, or t
  misc_feature (27520)..(27520): n is a, c, g, or t
  misc_feature (27647)..(27647): n is a, c, g, or t
  misc_feature (28570)..(28570): n is a, c, g, or t
  misc_feature (28584)..(28584): n is a, c, g, or t
  misc_feature (28658)..(28658): n is a, c, g, or t
  misc_feature (28964)..(28964): n is a, c, g, or t
  misc_feature (29031)..(29031): n is a, c, g, or t
  misc_feature (29197)..(29197): n is a, c, g, or t
  misc_feature (29388)..(29388): n is a, c, g, or t
  misc_feature (29394)..(29394): n is a, c, g, or t
  misc_feature (29400)..(29400): n is a, c, g, or t
  misc_feature (29409)..(29409): n is a, c, g, or t
  misc_feature (29491)..(29491): n is a, c, g, or t
  misc_feature (29567)..(29567): n is a, c, g, or t
  misc_feature (29637)..(29637): n is a, c, g, or t
  misc_feature (29682)..(29682): n is a, c, g, or t
  misc_feature (29901)..(29901): n is a, c, g, or t
  misc_feature (29905)..(29905): n is a, c, g, or t
  misc_feature (29922)..(29922): n is a, c, g, or t
  misc_feature (29925)..(29925): n is a, c, g, or t
  misc_feature (29950)..(29950): n is a, c, g, or t
  misc_feature (29958)..(29958): n is a, c, g, or t
  misc_feature (29963)..(29963): n is a, c, g, or t
  misc_feature (29966)..(29966): n is a, c, g, or t
  misc_feature (29968)..(29968): n is a, c, g, or t
  misc_feature (29972)..(29972): n is a, c, g, or t
  misc_feature (29974)..(29975): n is a, c, g, or t
  misc_feature (29977)..(29981): n is a, c, g, or t
  misc_feature (29983)..(29985): n is a, c, g, or t
  misc_feature (29987)..(29988): n is a, c, g, or t
  misc_feature (29991)..(29992): n is a, c, g, or t
  misc_feature (29994)..(29999): n is a, c, g, or t
  misc_feature (30001)..(30001): n is a, c, g, or t
  misc_feature (30003)..(30004): n is a, c, g, or t
  misc_feature (30006)..(30006): n is a, c, g, or t
  misc_feature (30008)..(30019): n is a, c, g, or t
  misc_feature (30021)..(30023): n is a, c, g, or t
  misc_feature (30025)..(30027): n is a, c, g, or t
  misc_feature (30029)..(30029): n is a, c, g, or t
  misc_feature (30031)..(30035): n is a, c, g, or t
  misc_feature (30037)..(30046): n is a, c, g, or t
  misc_feature (30048)..(30048): n is a, c, g, or t
  misc_feature (30050)..(30051): n is a, c, g, or t
  misc_feature (30053)..(30057): n is a, c, g, or t
  misc_feature (30059)..(30060): n is a, c, g, or t
  misc_feature (30063)..(30064): n is a, c, g, or t
  misc_feature (30066)..(30070): n is a, c, g, or t
  misc_feature (30072)..(30074): n is a, c, g, or t
  misc_feature (30077)..(30077): n is a, c, g, or t
  misc_feature (30080)..(30080): n is a, c, g, or t
  misc_feature (30082)..(30082): n is a, c, g, or t
  misc_feature (30085)..(30092): n is a, c, g, or t
  misc_feature (30094)..(30095): n is a, c, g, or t
  misc_feature (30097)..(30100): n is a, c, g, or t
  misc_feature (30102)..(30103): n is a, c, g, or t
  misc_feature (30105)..(30107): n is a, c, g, or t
  misc_feature (30109)..(30112): n is a, c, g, or t
  misc_feature (30114)..(30114): n is a, c, g, or t
  misc_feature (30117)..(30117): n is a, c, g, or t
  misc_feature (30119)..(30119): n is a, c, g, or t
  misc_feature (30121)..(30127): n is a, c, g, or t
  misc_feature (30129)..(30130): n is a, c, g, or t
  misc_feature (30133)..(30133): n is a, c, g, or t
  misc_feature (30135)..(30135): n is a, c, g, or t
  misc_feature (30138)..(30140): n is a, c, g, or t
  misc_feature (30142)..(30143): n is a, c, g, or t
  misc_feature (30146)..(30149): n is a, c, g, or t
  misc_feature (30151)..(30154): n is a, c, g, or t
  misc_feature (30158)..(30161): n is a, c, g, or t
  misc_feature (30163)..(30264): n is a, c, g, or t
  misc_feature (30873)..(30875): n is a, c, g, or t
  misc_feature (30877)..(30877): n is a, c, g, or t
  misc_feature (30879)..(30880): n is a, c, g, or t
  misc_feature (30882)..(30888): n is a, c, g, or t
  misc_feature (30890)..(30892): n is a, c, g, or t
  misc_feature (30894)..(30894): n is a, c, g, or t
  misc_feature (30899)..(30900): n is a, c, g, or t
  misc_feature (30908)..(30908): n is a, c, g, or t
  misc_feature (30921)..(30921): n is a, c, g, or t
  misc_feature (30935)..(30936): n is a, c, g, or t
  misc_feature (30946)..(30946): n is a, c, g, or t
  misc_feature (31050)..(31050): n is a, c, g, or t
  misc_feature (31704)..(31704): n is a, c, g, or t
  misc_feature (31733)..(31733): n is a, c, g, or t
  misc_feature (31747)..(31747): n is a, c, g, or t
  misc_feature (31757)..(31757): n is a, c, g, or t
  misc_feature (31760)..(31760): n is a, c, g, or t
  misc_feature (31927)..(31927): n is a, c, g, or t
  misc_feature (32142)..(32142): n is a, c, g, or t
  misc_feature (32227)..(32227): n is a, c, g, or t
  misc_feature (32229)..(32229): n is a, c, g, or t
  misc_feature (32234)..(32234): n is a, c, g, or t
  misc_feature (32258)..(32258): n is a, c, g, or t
  misc_feature (32261)..(32261): n is a, c, g, or t
  misc_feature (32300)..(32301): n is a, c, g, or t
  misc_feature (32875)..(32875): n is a, c, g, or t
  misc_feature (33026)..(33026): n is a, c, g, or t
  misc_feature (33099)..(33099): n is a, c, g, or t
  misc_feature (33108)..(33108): n is a, c, g, or t
  misc_feature (33217)..(33217): n is a, c, g, or t
  misc_feature (33338)..(33338): n is a, c, g, or t
  misc_feature (33419)..(33419): n is a, c, g, or t
  misc_feature (33549)..(33549): n is a, c, g, or t
  misc_feature (33750)..(33750): n is a, c, g, or t
  misc_feature (34178)..(34178): n is a, c, g, or t
  misc_feature (34320)..(34320): n is a, c, g, or t
  misc_feature (34607)..(34607): n is a, c, g, or t
  misc_feature (34806)..(34806): n is a, c, g, or t
  misc_feature (34835)..(34835): n is a, c, g, or t
  misc_feature (34844)..(34844): n is a, c, g, or t
  misc_feature (34847)..(34847): n is a, c, g, or t
  misc_feature (34904)..(34904): n is a, c, g, or t
  misc_feature (35029)..(35029): n is a, c, g, or t
  misc_feature (35071)..(35071): n is a, c, g, or t
  misc_feature (35542)..(35542): n is a, c, g, or t
  misc_feature (35548)..(35548): n is a, c, g, or t
  misc_feature (35590)..(35590): n is a, c, g, or t
  misc_feature (35936)..(35936): n is a, c, g, or t
  misc_feature (36063)..(36063): n is a, c, g, or t
  misc_feature (36104)..(36104): n is a, c, g, or t
  misc_feature (36110)..(36110): n is a, c, g, or t
  misc_feature (36221)..(36221): n is a, c, g, or t
  misc_feature (37194)..(37194): n is a, c, g, or t
  misc_feature (37299)..(37300): n is a, c, g, or t
  misc_feature (37302)..(37302): n is a, c, g, or t
  misc_feature (37306)..(37306): n is a, c, g, or t
  misc_feature (37308)..(37308): n is a, c, g, or t
  misc_feature (37319)..(37321): n is a, c, g, or t
  misc_feature (37403)..(37403): n is a, c, g, or t
  misc_feature (37405)..(37405): n is a, c, g, or t
  misc_feature (37410)..(37410): n is a, c, g, or t
  misc_feature (37415)..(37416): n is a, c, g, or t
  misc_feature (37427)..(37427): n is a, c, g, or t
  misc_feature (37429)..(37429): n is a, c, g, or t
  misc_feature (37451)..(37451): n is a, c, g, or t
  misc_feature (37453)..(37453): n is a, c, g, or t
  misc_feature (37462)..(37462): n is a, c, g, or t
  misc_feature (37484)..(37485): n is a, c, g, or t
  misc_feature (37487)..(37487): n is a, c, g, or t
  misc_feature (37490)..(37490): n is a, c, g, or t
  misc_feature (37492)..(37492): n is a, c, g, or t
  misc_feature (37504)..(37504): n is a, c, g, or t
  misc_feature (37521)..(37521): n is a, c, g, or t
  misc_feature (37539)..(37539): n is a, c, g, or t
  misc_feature (37873)..(37873): n is a, c, g, or t
  misc_feature (37877)..(37877): n is a, c, g, or t
  misc_feature (37879)..(37879): n is a, c, g, or t
  misc_feature (37883)..(37883): n is a, c, g, or t
  misc_feature (37926)..(37926): n is a, c, g, or t
  misc_feature (37938)..(37938): n is a, c, g, or t
  misc_feature (37940)..(37940): n is a, c, g, or t
  misc_feature (37950)..(37950): n is a, c, g, or t
  misc_feature (38023)..(38023): n is a, c, g, or t
  misc_feature (38069)..(38069): n is a, c, g, or t
  misc_feature (38098)..(38098): n is a, c, g, or t
  misc_feature (38100)..(38100): n is a, c, g, or t
  misc_feature (38215)..(38215): n is a, c, g, or t
  misc_feature (38223)..(38223): n is a, c, g, or t
  misc_feature (38375)..(38375): n is a, c, g, or t
  misc_feature (38500)..(38500): n is a, c, g, or t
  misc_feature (38711)..(38711): n is a, c, g, or t
  misc_feature (38772)..(38772): n is a, c, g, or t
  misc_feature (39000)..(39000): n is a, c, g, or t
  misc_feature (39123)..(39123): n is a, c, g, or t
  misc_feature (39347)..(39347): n is a, c, g, or t
  misc_feature (39350)..(39350): n is a, c, g, or t
  misc_feature (39379)..(39379): n is a, c, g, or t
  misc_feature (39463)..(39463): n is a, c, g, or t
  misc_feature (39548)..(39548): n is a, c, g, or t
  misc_feature (39551)..(39551): n is a, c, g, or t
  misc_feature (39553)..(39553): n is a, c, g, or t
  misc_feature (39962)..(39962): n is a, c, g, or t
  misc_feature (39968)..(39968): n is a, c, g, or t
  misc_feature (39970)..(39970): n is a, c, g, or t
  misc_feature (39992)..(39992): n is a, c, g, or t
  misc_feature (40059)..(40059): n is a, c, g, or t
  misc_feature (40136)..(40136): n is a, c, g, or t
  misc_feature (40259)..(40259): n is a, c, g, or t
  misc_feature (40546)..(40546): n is a, c, g, or t
  misc_feature (40561)..(40561): n is a, c, g, or t
  misc_feature (40615)..(40615): n is a, c, g, or t
  misc_feature (40635)..(40635): n is a, c, g, or t
  misc_feature (40641)..(40641): n is a, c, g, or t
  misc_feature (41095)..(41095): n is a, c, g, or t
  misc_feature (41340)..(41340): n is a, c, g, or t
  misc_feature (41380)..(41380): n is a, c, g, or t
  misc_feature (41530)..(41530): n is a, c, g, or t
  misc_feature (41565)..(41565): n is a, c, g, or t
  misc_feature (41664)..(41664): n is a, c, g, or t
  misc_feature (41823)..(41823): n is a, c, g, or t
  misc_feature (41931)..(41931): n is a, c, g, or t
  misc_feature (42369)..(42369): n is a, c, g, or t
  misc_feature (42401)..(42401): n is a, c, g, or t
  misc_feature (42551)..(42551): n is a, c, g, or t
  misc_feature (42671)..(42671): n is a, c, g, or t
  misc_feature (42679)..(42679): n is a, c, g, or t
  misc_feature (42855)..(42855): n is a, c, g, or t
  misc_feature (42932)..(42932): n is a, c, g, or t
  misc_feature (43008)..(43008): n is a, c, g, or t
  misc_feature (43036)..(43036): n is a, c, g, or t
  misc_feature (43038)..(43038): n is a, c, g, or t
  misc_feature (43135)..(43135): n is a, c, g, or t
  misc_feature (43305)..(43305): n is a, c, g, or t
  misc_feature (43385)..(43385): n is a, c, g, or t
  misc_feature (43409)..(43409): n is a, c, g, or t
  misc_feature (43736)..(43736): n is a, c, g, or t
  misc_feature (44011)..(44011): n is a, c, g, or t
  misc_feature (44090)..(44090): n is a, c, g, or t
  misc_feature (44135)..(44135): n is a, c, g, or t
  misc_feature (44196)..(44196): n is a, c, g, or t
  misc_feature (44210)..(44210): n is a, c, g, or t
  misc_feature (44213)..(44213): n is a, c, g, or t
  misc_feature (44219)..(44219): n is a, c, g, or t
  misc_feature (44256)..(44256): n is a, c, g, or t
  misc_feature (44348)..(44348): n is a, c, g, or t
  misc_feature (44489)..(44489): n is a, c, g, or t
  misc_feature (44887)..(44888): n is a, c, g, or t
  misc_feature (44900)..(44900): n is a, c, g, or t
  misc_feature (45401)..(45401): n is a, c, g, or t
  misc_feature (45404)..(45404): n is a, c, g, or t
  misc_feature (45407)..(45407): n is a, c, g, or t
  misc_feature (46283)..(46283): n is a, c, g, or t
  misc_feature (46285)..(46285): n is a, c, g, or t
  misc_feature (46291)..(46291): n is a, c, g, or t
  misc_feature (46398)..(46398): n is a, c, g, or t
  misc_feature (46740)..(46740): n is a, c, g, or t
  misc_feature (46785)..(46785): n is a, c, g, or t
  misc_feature (47306)..(47306): n is a, c, g, or t
  misc_feature (47554)..(47554): n is a, c, g, or t
  misc_feature (48039)..(48039): n is a, c, g, or t
  misc_feature (48045)..(48045): n is a, c, g, or t
  misc_feature (48155)..(48155): n is a, c, g, or t
  misc_feature (48729)..(48729): n is a, c, g, or t
  misc_feature (48799)..(48799): n is a, c, g, or t
  misc_feature (48995)..(48995): n is a, c, g, or t
  misc_feature (49437)..(49437): n is a, c, g, or t
  misc_feature (49581)..(49581): n is a, c, g, or t
  misc_feature (49617)..(49617): n is a, c, g, or t
  misc_feature (49702)..(49702): n is a, c, g, or t
  misc_feature (49712)..(49712): n is a, c, g, or t
  misc_feature (50158)..(50158): n is a, c, g, or t
  misc_feature (50269)..(50269): n is a, c, g, or t
  misc_feature (50474)..(50474): n is a, c, g, or t
  misc_feature (50509)..(50509): n is a, c, g, or t
  misc_feature (50584)..(50584): n is a, c, g, or t
  misc_feature (50639)..(50639): n is a, c, g, or t
  misc_feature (50853)..(50853): n is a, c, g, or t
  misc_feature (50869)..(50869): n is a, c, g, or t
  misc_feature (51442)..(51442): n is a, c, g, or t
  misc_feature (51455)..(51455): n is a, c, g, or t
  misc_feature (51481)..(51481): n is a, c, g, or t
  misc_feature (51718)..(51718): n is a, c, g, or t
  misc_feature (51721)..(51722): n is a, c, g, or t
  misc_feature (51726)..(51728): n is a, c, g, or t
  misc_feature (51731)..(51731): n is a, c, g, or t
  misc_feature (51733)..(51733): n is a, c, g, or t
  misc_feature (51762)..(51762): n is a, c, g, or t
  misc_feature (51765)..(51765): n is a, c, g, or t
  misc_feature (51782)..(51782): n is a, c, g, or t
  misc_feature (51795)..(51796): n is a, c, g, or t
  misc_feature (51812)..(51812): n is a, c, g, or t
  misc_feature (51816)..(51816): n is a, c, g, or t
  misc_feature (51988)..(51988): n is a, c, g, or t
  misc_feature (52600)..(52600): n is a, c, g, or t
  misc_feature (53019)..(53019): n is a, c, g, or t
  misc_feature (53211)..(53211): n is a, c, g, or t
  misc_feature (53507)..(53507): n is a, c, g, or t
  misc_feature (53535)..(53535): n is a, c, g, or t
  misc_feature (53541)..(53541): n is a, c, g, or t
  misc_feature (53545)..(53545): n is a, c, g, or t
  misc_feature (54155)..(54155): n is a, c, g, or t
  misc_feature (54528)..(54528): n is a, c, g, or t
  misc_feature (54684)..(54684): n is a, c, g, or t
  misc_feature (54686)..(54686): n is a, c, g, or t
  misc_feature (54802)..(54802): n is a, c, g, or t
  misc_feature (55085)..(55085): n is a, c, g, or t
  misc_feature (55446)..(55446): n is a, c, g, or t
  misc_feature (56197)..(56197): n is a, c, g, or t
  misc_feature (56237)..(56237): n is a, c, g, or t
  misc_feature (56267)..(56267): n is a, c, g, or t
  misc_feature (56285)..(56285): n is a, c, g, or t
  misc_feature (56598)..(56598): n is a, c, g, or t
  misc_feature (56646)..(56646): n is a, c, g, or t
  misc_feature (57325)..(57325): n is a, c, g, or t
  misc_feature (57345)..(57345): n is a, c, g, or t
  misc_feature (57461)..(57461): n is a, c, g, or t
  misc_feature (57610)..(57610): n is a, c, g, or t
  misc_feature (57773)..(57773): n is a, c, g, or t
  misc_feature (57777)..(57777): n is a, c, g, or t
  misc_feature (57829)..(57829): n is a, c, g, or t
  misc_feature (57895)..(57895): n is a, c, g, or t
  misc_feature (58348)..(58348): n is a, c, g, or t
  misc_feature (59421)..(59421): n is a, c, g, or t
  misc_feature (59792)..(59792): n is a, c, g, or t
  misc_feature (59935)..(59935): n is a, c, g, or t
  misc_feature (59982)..(59982): n is a, c, g, or t
  misc_feature (59986)..(59986): n is a, c, g, or t
  misc_feature (60146)..(60146): n is a, c, g, or t
  misc_feature (60152)..(60152): n is a, c, g, or t
  misc_feature (60155)..(60155): n is a, c, g, or t
  misc_feature (60161)..(60161): n is a, c, g, or t
  misc_feature (60193)..(60193): n is a, c, g, or t
  misc_feature (60236)..(60236): n is a, c, g, or t
  misc_feature (60248)..(60248): n is a, c, g, or t
  misc_feature (60296)..(60296): n is a, c, g, or t
  misc_feature (60445)..(60445): n is a, c, g, or t
  misc_feature (60538)..(60538): n is a, c, g, or t
  misc_feature (60544)..(60545): n is a, c, g, or t
  misc_feature (60549)..(60549): n is a, c, g, or t
  misc_feature (60812)..(60812): n is a, c, g, or t
  misc_feature (60882)..(60882): n is a, c, g, or t
  misc_feature (60959)..(60959): n is a, c, g, or t
  misc_feature (61005)..(61005): n is a, c, g, or t
  misc_feature (61170)..(61170): n is a, c, g, or t
  misc_feature (61520)..(61520): n is a, c, g, or t
  misc_feature (61638)..(61638): n is a, c, g, or t
  misc_feature (62012)..(62012): n is a, c, g, or t
  misc_feature (62223)..(62223): n is a, c, g, or t
  misc_feature (62248)..(62248): n is a, c, g, or t
  misc_feature (62409)..(62409): n is a, c, g, or t
  misc_feature (62420)..(62420): n is a, c, g, or t
  misc_feature (62682)..(62682): n is a, c, g, or t
  misc_feature (62698)..(62698): n is a, c, g, or t
  misc_feature (62722)..(62722): n is a, c, g, or t
  misc_feature (62729)..(62729): n is a, c, g, or t
  misc_feature (62745)..(62745): n is a, c, g, or t
  misc_feature (62874)..(62874): n is a, c, g, or t
  misc_feature (62975)..(62975): n is a, c, g, or t
  misc_feature (63180)..(63180): n is a, c, g, or t
  misc_feature (63429)..(63429): n is a, c, g, or t
  misc_feature (63463)..(63463): n is a, c, g, or t
  misc_feature (63467)..(63467): n is a, c, g, or t
  misc_feature (63740)..(63740): n is a, c, g, or t
  misc_feature (64003)..(64003): n is a, c, g, or t
  misc_feature (64059)..(64059): n is a, c, g, or t
  misc_feature (64478)..(64478): n is a, c, g, or t
  misc_feature (64579)..(64579): n is a, c, g, or t
  misc_feature (64831)..(64831): n is a, c, g, or t
  misc_feature (64902)..(64902): n is a, c, g, or t
  misc_feature (65021)..(65021): n is a, c, g, or t
  misc_feature (65025)..(65025): n is a, c, g, or t
  misc_feature (65363)..(65363): n is a, c, g, or t
  misc_feature (65481)..(65481): n is a, c, g, or t
  misc_feature (65665)..(65665): n is a, c, g, or t
  misc_feature (65961)..(65961): n is a, c, g, or t
  misc_feature (66348)..(66348): n is a, c, g, or t
  misc_feature (66350)..(66350): n is a, c, g, or t
  misc_feature (66375)..(66375): n is a, c, g, or t
  misc_feature (66514)..(66514): n is a, c, g, or t
  misc_feature (66609)..(66609): n is a, c, g, or t
  misc_feature (66616)..(66616): n is a, c, g, or t
  misc_feature (66619)..(66619): n is a, c, g, or t
  misc_feature (66623)..(66624): n is a, c, g, or t
  misc_feature (66730)..(66730): n is a, c, g, or t
  misc_feature (66882)..(66882): n is a, c, g, or t
  misc_feature (66917)..(66917): n is a, c, g, or t
  misc_feature (67309)..(67309): n is a, c, g, or t
  misc_feature (67333)..(67333): n is a, c, g, or t
  misc_feature (67403)..(67403): n is a, c, g, or t
  misc_feature (67460)..(67460): n is a, c, g, or t
  misc_feature (67551)..(67551): n is a, c, g, or t
  misc_feature (67658)..(67658): n is a, c, g, or t
  misc_feature (67678)..(67679): n is a, c, g, or t
  misc_feature (67951)..(67951): n is a, c, g, or t
  misc_feature (68347)..(68347): n is a, c, g, or t
  misc_feature (68400)..(68400): n is a, c, g, or t
  misc_feature (68404)..(68404): n is a, c, g, or t
  misc_feature (68420)..(68420): n is a, c, g, or t
  misc_feature (68617)..(68617): n is a, c, g, or t
  misc_feature (68630)..(68630): n is a, c, g, or t
  misc_feature (68653)..(68653): n is a, c, g, or t
  misc_feature (68675)..(68675): n is a, c, g, or t
  misc_feature (68685)..(68685): n is a, c, g, or t
  misc_feature (68733)..(68733): n is a, c, g, or t
  misc_feature (68780)..(68780): n is a, c, g, or t
  misc_feature (68870)..(68870): n is a, c, g, or t
  misc_feature (69029)..(69030): n is a, c, g, or t
  misc_feature (69032)..(69035): n is a, c, g, or t
  misc_feature (69037)..(69038): n is a, c, g, or t
  misc_feature (69040)..(69041): n is a, c, g, or t
  misc_feature (69045)..(69045): n is a, c, g, or t
  misc_feature (69047)..(69047): n is a, c, g, or t
  misc_feature (69049)..(69054): n is a, c, g, or t
  misc_feature (69057)..(69062): n is a, c, g, or t
  misc_feature (69064)..(69068): n is a, c, g, or t
  misc_feature (69070)..(69071): n is a, c, g, or t
  misc_feature (69073)..(69076): n is a, c, g, or t
  misc_feature (69078)..(69078): n is a, c, g, or t
  misc_feature (69080)..(69080): n is a, c, g, or t
  misc_feature (69082)..(69085): n is a, c, g, or t
  misc_feature (69087)..(69088): n is a, c, g, or t
  misc_feature (69090)..(69090): n is a, c, g, or t
  misc_feature (69092)..(69092): n is a, c, g, or t
  misc_feature (69095)..(69096): n is a, c, g, or t
  misc_feature (69098)..(69102): n is a, c, g, or t
  misc_feature (69104)..(69106): n is a, c, g, or t
  misc_feature (69108)..(69109): n is a, c, g, or t
  misc_feature (69111)..(69115): n is a, c, g, or t
  misc_feature (69119)..(69120): n is a, c, g, or t
  misc_feature (69123)..(69142): n is a, c, g, or t
  misc_feature (69145)..(69152): n is a, c, g, or t
  misc_feature (69154)..(69157): n is a, c, g, or t
  misc_feature (69160)..(69161): n is a, c, g, or t
  misc_feature (69163)..(69165): n is a, c, g, or t
  misc_feature (69168)..(69182): n is a, c, g, or t
  misc_feature (69184)..(69197): n is a, c, g, or t
  misc_feature (69201)..(69204): n is a, c, g, or t
  misc_feature (69206)..(69206): n is a, c, g, or t
  misc_feature (69209)..(69211): n is a, c, g, or t
  misc_feature (69213)..(69216): n is a, c, g, or t
  misc_feature (69218)..(69219): n is a, c, g, or t
  misc_feature (69221)..(69222): n is a, c, g, or t
  misc_feature (69225)..(69236): n is a, c, g, or t
  misc_feature (69238)..(69243): n is a, c, g, or t
  misc_feature (69245)..(69246): n is a, c, g, or t
  misc_feature (69248)..(69249): n is a, c, g, or t
  misc_feature (69251)..(69251): n is a, c, g, or t
  misc_feature (69253)..(69256): n is a, c, g, or t
  misc_feature (69258)..(69258): n is a, c, g, or t
  misc_feature (69260)..(69261): n is a, c, g, or t
  misc_feature (69263)..(69270): n is a, c, g, or t
  misc_feature (69272)..(69274): n is a, c, g, or t
  misc_feature (69277)..(69281): n is a, c, g, or t
  misc_feature (69283)..(69293): n is a, c, g, or t
  misc_feature (69295)..(69295): n is a, c, g, or t
  misc_feature (69297)..(69311): n is a, c, g, or t
  misc_feature (69314)..(69323): n is a, c, g, or t
  misc_feature (69325)..(69325): n is a, c, g, or t
  misc_feature (69327)..(69327): n is a, c, g, or t
  misc_feature (69329)..(69335): n is a, c, g, or t
  misc_feature (69337)..(69337): n is a, c, g, or t
  misc_feature (69339)..(69345): n is a, c, g, or t
  misc_feature (69348)..(69364): n is a, c, g, or t
  misc_feature (69366)..(69366): n is a, c, g, or t
  misc_feature (69368)..(69373): n is a, c, g, or t
  misc_feature (69375)..(69380): n is a, c, g, or t
  misc_feature (69383)..(69390): n is a, c, g, or t
  misc_feature (69392)..(69409): n is a, c, g, or t
  misc_feature (69411)..(69414): n is a, c, g, or t
  misc_feature (69416)..(69416): n is a, c, g, or t
  misc_feature (69418)..(69420): n is a, c, g, or t
  misc_feature (69422)..(69425): n is a, c, g, or t
  misc_feature (69428)..(69436): n is a, c, g, or t
  misc_feature (69438)..(69442): n is a, c, g, or t
  misc_feature (69445)..(69449): n is a, c, g, or t
  misc_feature (69451)..(69455): n is a, c, g, or t
  misc_feature (69458)..(69460): n is a, c, g, or t
  misc_feature (69462)..(69462): n is a, c, g, or t
  misc_feature (69464)..(69464): n is a, c, g, or t
  misc_feature (69466)..(69469): n is a, c, g, or t
  misc_feature (69471)..(69474): n is a, c, g, or t
  misc_feature (69476)..(69481): n is a, c, g, or t
  misc_feature (69483)..(69486): n is a, c, g, or t
  misc_feature (69490)..(69490): n is a, c, g, or t
  misc_feature (69496)..(69496): n is a, c, g, or t
  misc_feature (69498)..(69499): n is a, c, g, or t
  misc_feature (69501)..(69502): n is a, c, g, or t
  misc_feature (69504)..(69514): n is a, c, g, or t
  misc_feature (69516)..(69517): n is a, c, g, or t
  misc_feature (69520)..(69525): n is a, c, g, or t
  misc_feature (69576)..(69576): n is a, c, g, or t
  misc_feature (69579)..(69579): n is a, c, g, or t
  misc_feature (69614)..(69614): n is a, c, g, or t
  misc_feature (69635)..(69635): n is a, c, g, or t
  misc_feature (69646)..(69646): n is a, c, g, or t
  misc_feature (69728)..(69728): n is a, c, g, or t
  misc_feature (69730)..(69730): n is a, c, g, or t
  misc_feature (69780)..(69793): n is a, c, g, or t
  misc_feature (69795)..(69795): n is a, c, g, or t
  misc_feature (69797)..(69798): n is a, c, g, or t
  misc_feature (69800)..(69805): n is a, c, g, or t
  misc_feature (69808)..(69808): n is a, c, g, or t
  misc_feature (69819)..(69819): n is a, c, g, or t
  misc_feature (69839)..(69839): n is a, c, g, or t
  misc_feature (69937)..(69937): n is a, c, g, or t
  misc_feature (69959)..(69959): n is a, c, g, or t
  misc_feature (70047)..(70047): n is a, c, g, or t
  misc_feature (70070)..(70070): n is a, c, g, or t
  misc_feature (70088)..(70088): n is a, c, g, or t
  misc_feature (70097)..(70097): n is a, c, g, or t
  misc_feature (70192)..(70192): n is a, c, g, or t
  misc_feature (70195)..(70195): n is a, c, g, or t
  misc_feature (70230)..(70230): n is a, c, g, or t
  misc_feature (70246)..(70246): n is a, c, g, or t
  misc_feature (70262)..(70262): n is a, c, g, or t
  misc_feature (70394)..(70394): n is a, c, g, or t
  misc_feature (70402)..(70402): n is a, c, g, or t
  misc_feature (70439)..(70439): n is a, c, g, or t
  misc_feature (70529)..(70529): n is a, c, g, or t
  misc_feature (70536)..(70536): n is a, c, g, or t
  misc_feature (70550)..(70550): n is a, c, g, or t
  misc_feature (70643)..(70643): n is a, c, g, or t
  misc_feature (71090)..(71090): n is a, c, g, or t
  misc_feature (71121)..(71121): n is a, c, g, or t
  misc_feature (71216)..(71216): n is a, c, g, or t
  misc_feature (71239)..(71239): n is a, c, g, or t
  misc_feature (71396)..(71396): n is a, c, g, or t
  misc_feature (71787)..(71787): n is a, c, g, or t
  misc_feature (71893)..(71893): n is a, c, g, or t
  misc_feature (71986)..(71986): n is a, c, g, or t
  misc_feature (71994)..(71995): n is a, c, g, or t
  misc_feature (72017)..(72017): n is a, c, g, or t
  misc_feature (72040)..(72040): n is a, c, g, or t
  misc_feature (72095)..(72095): n is a, c, g, or t
  misc_feature (72421)..(72421): n is a, c, g, or t
  misc_feature (72434)..(72434): n is a, c, g, or t
  misc_feature (72646)..(72646): n is a, c, g, or t
  misc_feature (72728)..(72728): n is a, c, g, or t
  misc_feature (72762)..(72762): n is a, c, g, or t
  misc_feature (72989)..(72989): n is a, c, g, or t
  misc_feature (73024)..(73024): n is a, c, g, or t
  misc_feature (73028)..(73028): n is a, c, g, or t
  misc_feature (73039)..(73039): n is a, c, g, or t
  misc_feature (73089)..(73089): n is a, c, g, or t
  misc_feature (73130)..(73131): n is a, c, g, or t
  misc_feature (73192)..(73192): n is a, c, g, or t
  misc_feature (73216)..(73216): n is a, c, g, or t
  misc_feature (73240)..(73240): n is a, c, g, or t
  misc_feature (73291)..(73291): n is a, c, g, or t
  misc_feature (73327)..(73327): n is a, c, g, or t
  misc_feature (73577)..(73577): n is a, c, g, or t
  misc_feature (73607)..(73607): n is a, c, g, or t
  misc_feature (73635)..(73635): n is a, c, g, or t
  misc_feature (73644)..(73644): n is a, c, g, or t
  misc_feature (73725)..(73725): n is a, c, g, or t
  misc_feature (73742)..(73742): n is a, c, g, or t
  misc_feature (73759)..(73759): n is a, c, g, or t
  misc_feature (73846)..(73846): n is a, c, g, or t
  misc_feature (73853)..(73853): n is a, c, g, or t
  misc_feature (73863)..(73863): n is a, c, g, or t
  misc_feature (73866)..(73866): n is a, c, g, or t
  misc_feature (73869)..(73869): n is a, c, g, or t
  misc_feature (73898)..(73899): n is a, c, g, or t
  misc_feature (74728)..(74728): n is a, c, g, or t
  misc_feature (74905)..(74905): n is a, c, g, or t
  misc_feature (75091)..(75091): n is a, c, g, or t
  misc_feature (75104)..(75104): n is a, c, g, or t
  misc_feature (75106)..(75106): n is a, c, g, or t
  misc_feature (75124)..(75124): n is a, c, g, or t
  misc_feature (75367)..(75367): n is a, c, g, or t
  misc_feature (75400)..(75400): n is a, c, g, or t
  misc_feature (76064)..(76064): n is a, c, g, or t
  misc_feature (76071)..(76071): n is a, c, g, or t
  misc_feature (76076)..(76076): n is a, c, g, or t
  misc_feature (76112)..(76112): n is a, c, g, or t
  misc_feature (76212)..(76212): n is a, c, g, or t
  misc_feature (76574)..(76574): n is a, c, g, or t
  misc_feature (77184)..(77184): n is a, c, g, or t
  misc_feature (77775)..(77775): n is a, c, g, or t
  misc_feature (78056)..(78056): n is a, c, g, or t
  misc_feature (78097)..(78097): n is a, c, g, or t
  misc_feature (78434)..(78434): n is a, c, g, or t
  misc_feature (78849)..(78849): n is a, c, g, or t
  misc_feature (78963)..(78963): n is a, c, g, or t
  misc_feature (78965)..(78966): n is a, c, g, or t
  misc_feature (78971)..(78972): n is a, c, g, or t
  misc_feature (78976)..(78977): n is a, c, g, or t
  misc_feature (78979)..(78981): n is a, c, g, or t
  misc_feature (78983)..(78983): n is a, c, g, or t
  misc_feature (78985)..(78987): n is a, c, g, or t
  misc_feature (78992)..(78993): n is a, c, g, or t
  misc_feature (79339)..(79339): n is a, c, g, or t
  misc_feature (79477)..(79477): n is a, c, g, or t
  misc_feature (79489)..(79489): n is a, c, g, or t
  misc_feature (79493)..(79493): n is a, c, g, or t
  misc_feature (79688)..(79688): n is a, c, g, or t
  misc_feature (80072)..(80072): n is a, c, g, or t
  misc_feature (80238)..(80238): n is a, c, g, or t
  misc_feature (80263)..(80263): n is a, c, g, or t
  misc_feature (80487)..(80487): n is a, c, g, or t
  misc_feature (80617)..(80617): n is a, c, g, or t
  misc_feature (80890)..(80890): n is a, c, g, or t
  misc_feature (81616)..(81616): n is a, c, g, or t
  misc_feature (81815)..(81815): n is a, c, g, or t
  misc_feature (81826)..(81826): n is a, c, g, or t
  misc_feature (82100)..(82100): n is a, c, g, or t
  misc_feature (82196)..(82196): n is a, c, g, or t
  misc_feature (82298)..(82298): n is a, c, g, or t
  misc_feature (82774)..(82774): n is a, c, g, or t
  misc_feature (82925)..(82925): n is a, c, g, or t
  misc_feature (83080)..(83080): n is a, c, g, or t
  misc_feature (83087)..(83087): n is a, c, g, or t
  misc_feature (83115)..(83115): n is a, c, g, or t
  misc_feature (83323)..(83323): n is a, c, g, or t
  misc_feature (84261)..(84261): n is a, c, g, or t
  misc_feature (84404)..(84404): n is a, c, g, or t
  misc_feature (84641)..(84641): n is a, c, g, or t
  misc_feature (85012)..(85012): n is a, c, g, or t
  misc_feature (85014)..(85014): n is a, c, g, or t
  misc_feature (85098)..(85098): n is a, c, g, or t
  misc_feature (85105)..(85105): n is a, c, g, or t
  misc_feature (85109)..(85109): n is a, c, g, or t
  misc_feature (85187)..(85187): n is a, c, g, or t
  misc_feature (85202)..(85202): n is a, c, g, or t
  misc_feature (85377)..(85377): n is a, c, g, or t
  misc_feature (85550)..(85550): n is a, c, g, or t
  misc_feature (85752)..(85752): n is a, c, g, or t
  misc_feature (86017)..(86017): n is a, c, g, or t
  misc_feature (86170)..(86170): n is a, c, g, or t
  misc_feature (86350)..(86350): n is a, c, g, or t
  misc_feature (86492)..(86492): n is a, c, g, or t
  misc_feature (86712)..(86712): n is a, c, g, or t
  misc_feature (86877)..(86877): n is a, c, g, or t
  misc_feature (87016)..(87016): n is a, c, g, or t
  misc_feature (87087)..(87087): n is a, c, g, or t
  misc_feature (87517)..(87517): n is a, c, g, or t
  misc_feature (87520)..(87520): n is a, c, g, or t
  misc_feature (87782)..(87782): n is a, c, g, or t
  misc_feature (87829)..(87829): n is a, c, g, or t
  misc_feature (87855)..(87855): n is a, c, g, or t
  misc_feature (87941)..(87941): n is a, c, g, or t
  misc_feature (88111)..(88111): n is a, c, g, or t
  misc_feature (88122)..(88122): n is a, c, g, or t
  misc_feature (88306)..(88306): n is a, c, g, or t
  misc_feature (88355)..(88355): n is a, c, g, or t
  misc_feature (88701)..(88701): n is a, c, g, or t
  misc_feature (89043)..(89043): n is a, c, g, or t
  misc_feature (89045)..(89045): n is a, c, g, or t
  misc_feature (89050)..(89050): n is a, c, g, or t
  misc_feature (89184)..(89184): n is a, c, g, or t
  misc_feature (89186)..(89186): n is a, c, g, or t
  misc_feature (89189)..(89189): n is a, c, g, or t
  misc_feature (89208)..(89208): n is a, c, g, or t
  misc_feature (89210)..(89210): n is a, c, g, or t
  misc_feature (89213)..(89213): n is a, c, g, or t
  misc_feature (89233)..(89233): n is a, c, g, or t
  misc_feature (89237)..(89237): n is a, c, g, or t
  misc_feature (89248)..(89249): n is a, c, g, or t
  misc_feature (89254)..(89254): n is a, c, g, or t
  misc_feature (89269)..(89269): n is a, c, g, or t
  misc_feature (89274)..(89275): n is a, c, g, or t
  misc_feature (89277)..(89277): n is a, c, g, or t
  misc_feature (89282)..(89283): n is a, c, g, or t
  misc_feature (89286)..(89286): n is a, c, g, or t
  misc_feature (89288)..(89288): n is a, c, g, or t
  misc_feature (89290)..(89291): n is a, c, g, or t
  misc_feature (89301)..(89301): n is a, c, g, or t
  misc_feature (89303)..(89303): n is a, c, g, or t
  misc_feature (89306)..(89306): n is a, c, g, or t
  misc_feature (89309)..(89310): n is a, c, g, or t
  misc_feature (89314)..(89314): n is a, c, g, or t
  misc_feature (89326)..(89328): n is a, c, g, or t
  misc_feature (89330)..(89330): n is a, c, g, or t
  misc_feature (89335)..(89335): n is a, c, g, or t
  misc_feature (89337)..(89337): n is a, c, g, or t
  misc_feature (89342)..(89342): n is a, c, g, or t
  misc_feature (89344)..(89344): n is a, c, g, or t
  misc_feature (89348)..(89349): n is a, c, g, or t
  misc_feature (89351)..(89351): n is a, c, g, or t
  misc_feature (89353)..(89353): n is a, c, g, or t
  misc_feature (89355)..(89362): n is a, c, g, or t
  misc_feature (89364)..(89365): n is a, c, g, or t
  misc_feature (89367)..(89371): n is a, c, g, or t
  misc_feature (89373)..(89374): n is a, c, g, or t
  misc_feature (89376)..(89409): n is a, c, g, or t
  misc_feature (89424)..(89424): n is a, c, g, or t
  misc_feature (89432)..(89433): n is a, c, g, or t
  misc_feature (89437)..(89438): n is a, c, g, or t
  misc_feature (89444)..(89444): n is a, c, g, or t
  misc_feature (89453)..(89453): n is a, c, g, or t
  misc_feature (89455)..(89455): n is a, c, g, or t
  misc_feature (89458)..(89458): n is a, c, g, or t
  misc_feature (89479)..(89480): n is a, c, g, or t
  misc_feature (89491)..(89491): n is a, c, g, or t
  misc_feature (89501)..(89501): n is a, c, g, or t
  misc_feature (89504)..(89504): n is a, c, g, or t
  misc_feature (89510)..(89510): n is a, c, g, or t
  misc_feature (89522)..(89522): n is a, c, g, or t
  misc_feature (89577)..(89577): n is a, c, g, or t
  misc_feature (89610)..(89610): n is a, c, g, or t
  misc_feature (90095)..(90095): n is a, c, g, or t
  misc_feature (90102)..(90102): n is a, c, g, or t
  misc_feature (90128)..(90128): n is a, c, g, or t
  misc_feature (90169)..(90170): n is a, c, g, or t
  misc_feature (90184)..(90184): n is a, c, g, or t
  misc_feature (90186)..(90186): n is a, c, g, or t
  misc_feature (90202)..(90203): n is a, c, g, or t
  misc_feature (90217)..(90217): n is a, c, g, or t
  misc_feature (90224)..(90224): n is a, c, g, or t
  misc_feature (90227)..(90227): n is a, c, g, or t
  misc_feature (90231)..(90231): n is a, c, g, or t
  misc_feature (90236)..(90236): n is a, c, g, or t
  misc_feature (90243)..(90244): n is a, c, g, or t
  misc_feature (90246)..(90249): n is a, c, g, or t
  misc_feature (90251)..(90251): n is a, c, g, or t
  misc_feature (90254)..(90254): n is a, c, g, or t
  misc_feature (90257)..(90258): n is a, c, g, or t
  misc_feature (90260)..(90260): n is a, c, g, or t
  misc_feature (90262)..(90266): n is a, c, g, or t
  misc_feature (90300)..(90300): n is a, c, g, or t
  misc_feature (90392)..(90392): n is a, c, g, or t
  misc_feature (90489)..(90489): n is a, c, g, or t
  misc_feature (90653)..(90653): n is a, c, g, or t
  misc_feature (90680)..(90680): n is a, c, g, or t
  misc_feature (90684)..(90684): n is a, c, g, or t
  misc_feature (91185)..(91185): n is a, c, g, or t
  misc_feature (91190)..(91190): n is a, c, g, or t
  misc_feature (91412)..(91412): n is a, c, g, or t
  misc_feature (91419)..(91419): n is a, c, g, or t
  misc_feature (91426)..(91426): n is a, c, g, or t
  misc_feature (91453)..(91456): n is a, c, g, or t
  misc_feature (91459)..(91463): n is a, c, g, or t
  misc_feature (91465)..(91474): n is a, c, g, or t
  misc_feature (91523)..(91523): n is a, c, g, or t
  misc_feature (91604)..(91604): n is a, c, g, or t
  misc_feature (91607)..(91607): n is a, c, g, or t
  misc_feature (91636)..(91637): n is a, c, g, or t
  misc_feature (91646)..(91646): n is a, c, g, or t
  misc_feature (91663)..(91663): n is a, c, g, or t
  misc_feature (91669)..(91669): n is a, c, g, or t
  misc_feature (91983)..(91983): n is a, c, g, or t
  misc_feature (92951)..(92951): n is a, c, g, or t
  misc_feature (92967)..(92967): n is a, c, g, or t
  misc_feature (93308)..(93308): n is a, c, g, or t
  misc_feature (93385)..(93385): n is a, c, g, or t
  misc_feature (93693)..(93693): n is a, c, g, or t
  misc_feature (93762)..(93762): n is a, c, g, or t
  misc_feature (93822)..(93822): n is a, c, g, or t
  misc_feature (94622)..(94622): n is a, c, g, or t
  misc_feature (94659)..(94659): n is a, c, g, or t
  misc_feature (94727)..(94727): n is a, c, g, or t
  misc_feature (94729)..(94729): n is a, c, g, or t
  misc_feature (94731)..(94731): n is a, c, g, or t
  misc_feature (94751)..(94751): n is a, c, g, or t
  misc_feature (94799)..(94799): n is a, c, g, or t
  misc_feature (94879)..(94879): n is a, c, g, or t
  misc_feature (94882)..(94882): n is a, c, g, or t
  misc_feature (95006)..(95006): n is a, c, g, or t
  misc_feature (95292)..(95292): n is a, c, g, or t
  misc_feature (95294)..(95294): n is a, c, g, or t
  misc_feature (95296)..(95296): n is a, c, g, or t
  misc_feature (95328)..(95328): n is a, c, g, or t
  misc_feature (95335)..(95335): n is a, c, g, or t
  misc_feature (95467)..(95467): n is a, c, g, or t
  misc_feature (95497)..(95497): n is a, c, g, or t
  misc_feature (95599)..(95599): n is a, c, g, or t
  misc_feature (95849)..(95849): n is a, c, g, or t
  misc_feature (95915)..(95915): n is a, c, g, or t
  misc_feature (95922)..(95922): n is a, c, g, or t
  misc_feature (95957)..(95957): n is a, c, g, or t
  misc_feature (95989)..(95989): n is a, c, g, or t
  misc_feature (96130)..(96130): n is a, c, g, or t
  misc_feature (96481)..(96481): n is a, c, g, or t
  misc_feature (96794)..(96794): n is a, c, g, or t
  misc_feature (96934)..(96934): n is a, c, g, or t
  misc_feature (97001)..(97001): n is a, c, g, or t
  misc_feature (97026)..(97026): n is a, c, g, or t
  misc_feature (97064)..(97064): n is a, c, g, or t
  misc_feature (97081)..(97081): n is a, c, g, or t
  misc_feature (97117)..(97117): n is a, c, g, or t
  misc_feature (97319)..(97319): n is a, c, g, or t
  misc_feature (97341)..(97341): n is a, c, g, or t
  misc_feature (97353)..(97353): n is a, c, g, or t
  misc_feature (97474)..(97474): n is a, c, g, or t
  misc_feature (97477)..(97477): n is a, c, g, or t
  misc_feature (97637)..(97637): n is a, c, g, or t
  misc_feature (97653)..(97653): n is a, c, g, or t
  misc_feature (97795)..(97795): n is a, c, g, or t
  misc_feature (97842)..(97842): n is a, c, g, or t
  misc_feature (97977)..(97977): n is a, c, g, or t
  misc_feature (97981)..(97981): n is a, c, g, or t
  misc_feature (98057)..(98057): n is a, c, g, or t
  misc_feature (98232)..(98232): n is a, c, g, or t
  misc_feature (98258)..(98258): n is a, c, g, or t
  misc_feature (98289)..(98289): n is a, c, g, or t
  misc_feature (98324)..(98324): n is a, c, g, or t
  misc_feature (98632)..(98632): n is a, c, g, or t
  misc_feature (98664)..(98664): n is a, c, g, or t
  misc_feature (98919)..(98919): n is a, c, g, or t
  misc_feature (98964)..(98964): n is a, c, g, or t
  misc_feature (99958)..(99958): n is a, c, g, or t
  misc_feature (100515)..(100515): n is a, c, g, or t
  misc_feature (100727)..(100727): n is a, c, g, or t
  misc_feature (101006)..(101006): n is a, c, g, or t
  misc_feature (101857)..(101857): n is a, c, g, or t
  misc_feature (102143)..(102143): n is a, c, g, or t
  misc_feature (102351)..(102351): n is a, c, g, or t
  misc_feature (102506)..(102506): n is a, c, g, or t
  misc_feature (102558)..(102558): n is a, c, g, or t
  misc_feature (102796)..(102796): n is a, c, g, or t
  misc_feature (103001)..(103001): n is a, c, g, or t
  misc_feature (103015)..(103015): n is a, c, g, or t
  misc_feature (103359)..(103359): n is a, c, g, or t
  misc_feature (103363)..(103363): n is a, c, g, or t
  misc_feature (103405)..(103405): n is a, c, g, or t
  misc_feature (103481)..(103481): n is a, c, g, or t
  misc_feature (103484)..(103484): n is a, c, g, or t
  misc_feature (103530)..(103530): n is a, c, g, or t
  misc_feature (103580)..(103580): n is a, c, g, or t
  misc_feature (103834)..(103834): n is a, c, g, or t
  misc_feature (104006)..(104006): n is a, c, g, or t
  misc_feature (104012)..(104012): n is a, c, g, or t
  misc_feature (104014)..(104014): n is a, c, g, or t
  misc_feature (104017)..(104017): n is a, c, g, or t
  misc_feature (104122)..(104122): n is a, c, g, or t
  misc_feature (104206)..(104206): n is a, c, g, or t
  misc_feature (104293)..(104293): n is a, c, g, or t
  misc_feature (104326)..(104326): n is a, c, g, or t
  misc_feature (104491)..(104491): n is a, c, g, or t
  misc_feature (104789)..(104789): n is a, c, g, or t
  misc_feature (105270)..(105270): n is a, c, g, or t
  misc_feature (105556)..(105556): n is a, c, g, or t
  misc_feature (105896)..(105896): n is a, c, g, or t
  misc_feature (105927)..(105927): n is a, c, g, or t
  misc_feature (106002)..(106002): n is a, c, g, or t
  misc_feature (106018)..(106018): n is a, c, g, or t
  misc_feature (106329)..(106329): n is a, c, g, or t
  misc_feature (106418)..(106418): n is a, c, g, or t
  misc_feature (106530)..(106530): n is a, c, g, or t
  misc_feature (106635)..(106635): n is a, c, g, or t
  misc_feature (107280)..(107280): n is a, c, g, or t
  misc_feature (107313)..(107313): n is a, c, g, or t
  misc_feature (107722)..(107722): n is a, c, g, or t
  misc_feature (107725)..(107725): n is a, c, g, or t
  misc_feature (107759)..(107759): n is a, c, g, or t
  misc_feature (107761)..(107761): n is a, c, g, or t
  misc_feature (107783)..(107783): n is a, c, g, or t
  misc_feature (108103)..(108103): n is a, c, g, or t
  misc_feature (108422)..(108422): n is a, c, g, or t
  misc_feature (108554)..(108554): n is a, c, g, or t
  misc_feature (108666)..(108666): n is a, c, g, or t
  misc_feature (108756)..(108756): n is a, c, g, or t
  misc_feature (109185)..(109185): n is a, c, g, or t
  misc_feature (109212)..(109213): n is a, c, g, or t
  misc_feature (109295)..(109295): n is a, c, g, or t
  misc_feature (109316)..(109316): n is a, c, g, or t
  misc_feature (109354)..(109354): n is a, c, g, or t
  misc_feature (109388)..(109388): n is a, c, g, or t
  misc_feature (109403)..(109403): n is a, c, g, or t
  misc_feature (109417)..(109417): n is a, c, g, or t
  misc_feature (109476)..(109476): n is a, c, g, or t
  misc_feature (109478)..(109478): n is a, c, g, or t
  misc_feature (109499)..(109499): n is a, c, g, or t
  misc_feature (109502)..(109502): n is a, c, g, or t
  misc_feature (109506)..(109506): n is a, c, g, or t
  misc_feature (109508)..(109510): n is a, c, g, or t
  misc_feature (109514)..(109514): n is a, c, g, or t
  misc_feature (109516)..(109516): n is a, c, g, or t
  misc_feature (109519)..(109531): n is a, c, g, or t
  misc_feature (109533)..(109533): n is a, c, g, or t
  misc_feature (109535)..(109535): n is a, c, g, or t
  misc_feature (109537)..(109537): n is a, c, g, or t
  misc_feature (109539)..(109544): n is a, c, g, or t
  misc_feature (109546)..(109550): n is a, c, g, or t
  misc_feature (109552)..(109552): n is a, c, g, or t
  misc_feature (109555)..(109556): n is a, c, g, or t
  misc_feature (109558)..(109561): n is a, c, g, or t
  misc_feature (109565)..(109569): n is a, c, g, or t
  misc_feature (109572)..(109575): n is a, c, g, or t
  misc_feature (109579)..(109585): n is a, c, g, or t
  misc_feature (109587)..(109588): n is a, c, g, or t
  misc_feature (109590)..(109591): n is a, c, g, or t
  misc_feature (109593)..(109593): n is a, c, g, or t
  misc_feature (109595)..(109599): n is a, c, g, or t
  misc_feature (109601)..(109604): n is a, c, g, or t
  misc_feature (109606)..(109606): n is a, c, g, or t
  misc_feature (109608)..(109621): n is a, c, g, or t
  misc_feature (109623)..(109623): n is a, c, g, or t
  misc_feature (109625)..(109627): n is a, c, g, or t
  misc_feature (109629)..(109629): n is a, c, g, or t
  misc_feature (109656)..(109656): n is a, c, g, or t
  misc_feature (109683)..(109683): n is a, c, g, or t
  misc_feature (109697)..(109698): n is a, c, g, or t
  misc_feature (109715)..(109715): n is a, c, g, or t
  misc_feature (109942)..(109942): n is a, c, g, or t
  misc_feature (110556)..(110556): n is a, c, g, or t
  misc_feature (110559)..(110559): n is a, c, g, or t
  misc_feature (110562)..(110562): n is a, c, g, or t
  misc_feature (111549)..(111549): n is a, c, g, or t
  misc_feature (111551)..(111551): n is a, c, g, or t
  misc_feature (111596)..(111596): n is a, c, g, or t
  misc_feature (111639)..(111639): n is a, c, g, or t
  misc_feature (111697)..(111697): n is a, c, g, or t
  misc_feature (111800)..(111800): n is a, c, g, or t
  misc_feature (112119)..(112119): n is a, c, g, or t
  misc_feature (112166)..(112166): n is a, c, g, or t
  misc_feature (112168)..(112168): n is a, c, g, or t
  misc_feature (112261)..(112261): n is a, c, g, or t
  misc_feature (112355)..(112355): n is a, c, g, or t
  misc_feature (112906)..(112906): n is a, c, g, or t
  misc_feature (113411)..(113411): n is a, c, g, or t
  misc_feature (113488)..(113488): n is a, c, g, or t
  misc_feature (113825)..(113825): n is a, c, g, or t
  misc_feature (114329)..(114329): n is a, c, g, or t
  misc_feature (114364)..(114364): n is a, c, g, or t
  misc_feature (114369)..(114369): n is a, c, g, or t
  misc_feature (114374)..(114374): n is a, c, g, or t
  misc_feature (114429)..(114429): n is a, c, g, or t
  misc_feature (114433)..(114433): n is a, c, g, or t
  misc_feature (114687)..(114687): n is a, c, g, or t
  misc_feature (115127)..(115127): n is a, c, g, or t
  misc_feature (115222)..(115222): n is a, c, g, or t
  misc_feature (115241)..(115241): n is a, c, g, or t
  misc_feature (115248)..(115248): n is a, c, g, or t
  misc_feature (115335)..(115335): n is a, c, g, or t
  misc_feature (115354)..(115354): n is a, c, g, or t
  misc_feature (115534)..(115534): n is a, c, g, or t
  misc_feature (115587)..(115587): n is a, c, g, or t
  misc_feature (115607)..(115607): n is a, c, g, or t
  misc_feature (116223)..(116223): n is a, c, g, or t
  misc_feature (116759)..(116759): n is a, c, g, or t
  misc_feature (116850)..(116850): n is a, c, g, or t
  misc_feature (117382)..(117382): n is a, c, g, or t
  misc_feature (117386)..(117386): n is a, c, g, or t
  misc_feature (117443)..(117443): n is a, c, g, or t
  misc_feature (117576)..(117576): n is a, c, g, or t
  misc_feature (117699)..(117699): n is a, c, g, or t
  misc_feature (117717)..(117717): n is a, c, g, or t
  misc_feature (117814)..(117814): n is a, c, g, or t
  misc_feature (118096)..(118096): n is a, c, g, or t
  misc_feature (118242)..(118242): n is a, c, g, or t
  misc_feature (118585)..(118585): n is a, c, g, or t
  misc_feature (118718)..(118718): n is a, c, g, or t
  misc_feature (118811)..(118811): n is a, c, g, or t
  misc_feature (118817)..(118817): n is a, c, g, or t
  misc_feature (118825)..(118825): n is a, c, g, or t
  misc_feature (118832)..(118832): n is a, c, g, or t
  misc_feature (119247)..(119247): n is a, c, g, or t
  misc_feature (119391)..(119391): n is a, c, g, or t
  misc_feature (119527)..(119527): n is a, c, g, or t
  misc_feature (119539)..(119539): n is a, c, g, or t
  misc_feature (120026)..(120026): n is a, c, g, or t
  misc_feature (120251)..(120251): n is a, c, g, or t
  misc_feature (120466)..(120466): n is a, c, g, or t
  misc_feature (120529)..(120529): n is a, c, g, or t
  misc_feature (120979)..(120979): n is a, c, g, or t
  misc_feature (121301)..(121302): n is a, c, g, or t
  misc_feature (121305)..(121306): n is a, c, g, or t
  misc_feature (121310)..(121311): n is a, c, g, or t
  misc_feature (121324)..(121324): n is a, c, g, or t
  misc_feature (121333)..(121334): n is a, c, g, or t
  misc_feature (121431)..(121431): n is a, c, g, or t
  misc_feature (121452)..(121452): n is a, c, g, or t
  misc_feature (121811)..(121811): n is a, c, g, or t
  misc_feature (121958)..(121958): n is a, c, g, or t
  misc_feature (122133)..(122133): n is a, c, g, or t
  misc_feature (122176)..(122176): n is a, c, g, or t
  misc_feature (122266)..(122266): n is a, c, g, or t
  misc_feature (122382)..(122382): n is a, c, g, or t
  misc_feature (122628)..(122628): n is a, c, g, or t
  misc_feature (122701)..(122701): n is a, c, g, or t
  misc_feature (122767)..(122767): n is a, c, g, or t
  misc_feature (122874)..(122874): n is a, c, g, or t
  misc_feature (122918)..(122918): n is a, c, g, or t
  misc_feature (122925)..(122925): n is a, c, g, or t
  misc_feature (122935)..(122935): n is a, c, g, or t
  misc_feature (123052)..(123052): n is a, c, g, or t
  misc_feature (123061)..(123061): n is a, c, g, or t
  misc_feature (123068)..(123068): n is a, c, g, or t
  misc_feature (123074)..(123074): n is a, c, g, or t
  misc_feature (123082)..(123082): n is a, c, g, or t
  misc_feature (123087)..(123087): n is a, c, g, or t
  misc_feature (123090)..(123090): n is a, c, g, or t
  misc_feature (123093)..(123093): n is a, c, g, or t
  misc_feature (123106)..(123107): n is a, c, g, or t
  misc_feature (123116)..(123116): n is a, c, g, or t
  misc_feature (123171)..(123171): n is a, c, g, or t
  misc_feature (123531)..(123531): n is a, c, g, or t
  misc_feature (123585)..(123585): n is a, c, g, or t
  misc_feature (123641)..(123641): n is a, c, g, or t
  misc_feature (123650)..(123650): n is a, c, g, or t
  misc_feature (123658)..(123658): n is a, c, g, or t
  misc_feature (123666)..(123666): n is a, c, g, or t
  misc_feature (123710)..(123710): n is a, c, g, or t
  misc_feature (123720)..(123720): n is a, c, g, or t
  misc_feature (123944)..(123944): n is a, c, g, or t
  misc_feature (124035)..(124035): n is a, c, g, or t
  misc_feature (124193)..(124193): n is a, c, g, or t
  misc_feature (124880)..(124880): n is a, c, g, or t
  misc_feature (125131)..(125131): n is a, c, g, or t
  misc_feature (125292)..(125292): n is a, c, g, or t
  misc_feature (125462)..(125462): n is a, c, g, or t
  misc_feature (125557)..(125558): n is a, c, g, or t
  misc_feature (125561)..(125573): n is a, c, g, or t
  misc_feature (125575)..(125579): n is a, c, g, or t
  misc_feature (125581)..(125592): n is a, c, g, or t
  misc_feature (125594)..(125595): n is a, c, g, or t
  misc_feature (125597)..(125603): n is a, c, g, or t
  misc_feature (125605)..(125608): n is a, c, g, or t
  misc_feature (125610)..(125625): n is a, c, g, or t
  misc_feature (125627)..(125633): n is a, c, g, or t
  misc_feature (125635)..(125639): n is a, c, g, or t
  misc_feature (125641)..(125658): n is a, c, g, or t
  misc_feature (125660)..(125660): n is a, c, g, or t
  misc_feature (125662)..(125664): n is a, c, g, or t
  misc_feature (125666)..(125671): n is a, c, g, or t
  misc_feature (125673)..(125675): n is a, c, g, or t
  misc_feature (125677)..(125677): n is a, c, g, or t
  misc_feature (125680)..(125682): n is a, c, g, or t
  misc_feature (125684)..(125685): n is a, c, g, or t
  misc_feature (125687)..(125690): n is a, c, g, or t
  misc_feature (125692)..(125692): n is a, c, g, or t
  misc_feature (125694)..(125697): n is a, c, g, or t
  misc_feature (125700)..(125706): n is a, c, g, or t
  misc_feature (125708)..(125711): n is a, c, g, or t
  misc_feature (125713)..(125713): n is a, c, g, or t
  misc_feature (125715)..(125720): n is a, c, g, or t
  misc_feature (125722)..(125723): n is a, c, g, or t
  misc_feature (125725)..(125729): n is a, c, g, or t
  misc_feature (125732)..(125739): n is a, c, g, or t
  misc_feature (125742)..(125743): n is a, c, g, or t
  misc_feature (125746)..(125750): n is a, c, g, or t
  misc_feature (125753)..(125753): n is a, c, g, or t
  misc_feature (125756)..(125760): n is a, c, g, or t
  misc_feature (125762)..(125765): n is a, c, g, or t
  misc_feature (125767)..(125769): n is a, c, g, or t
  misc_feature (125771)..(125779): n is a, c, g, or t
  misc_feature (125781)..(125785): n is a, c, g, or t
  misc_feature (125787)..(125787): n is a, c, g, or t
  misc_feature (125789)..(125791): n is a, c, g, or t
  misc_feature (125793)..(125793): n is a, c, g, or t
  misc_feature (125795)..(125806): n is a, c, g, or t
  misc_feature (125808)..(125810): n is a, c, g, or t
  misc_feature (125812)..(125816): n is a, c, g, or t
  misc_feature (125818)..(125821): n is a, c, g, or t
  misc_feature (125824)..(125827): n is a, c, g, or t
  misc_feature (125829)..(125834): n is a, c, g, or t
  misc_feature (125836)..(125842): n is a, c, g, or t
  misc_feature (125844)..(125848): n is a, c, g, or t
  misc_feature (125850)..(125851): n is a, c, g, or t
  misc_feature (125853)..(125888): n is a, c, g, or t
  misc_feature (125890)..(125910): n is a, c, g, or t
  misc_feature (125912)..(175911): n is a, c, g, or t
  misc_feature (216913)..(266912): n is a, c, g, or t
  misc_feature (292655)..(293400): n is a, c, g, or t
  misc_feature (294233)..(294332): n is a, c, g, or t
ctgcactttttgcttataaaaacttcaatccatttcgggagtggaggttcctacctgggatcacgagcattttgggacaggctgatgtacagggataatcacgtgaggacatggacactgttctggctctgatgcagggcatccgatgggtcttgaggacgtaaacatggaccttcatcccgtgtcatcctctctggacccccaggagtccaagagaaggggcatcattagtccgattgacagtggcagcaacctcaccacagaacctcatctgtccagcttgatcatcaccaacaggtgcacttgggtggaggcacctcggaaccgcctcatgggcgctctacgctagacttatcgtgccctccccctcggagacgcctcatgagagctctctgctagacttaccctgccctcacaagttggagtatgaagcgcaaaaccagtagaatgtaaccaaggagctggccttcctggaggctgccaggcagcaagctttacagcccctgggggagcgcgatggtgacttctaaccaggcagaagccctgcgcgacctcacctgctttgttcttggcctctgcgtttggactaggaattgcaggacttcctctctactggcctgctctggaaggctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcagcgcgccgagtctgcgtatggccggggtacgaggcgctccctgcgcagggtgggcaggaccgaagctcgccgggagnctgncgcggangggcgggcggggaccctcggctgccgctcccacccccgcggggccgcncccgagcccgncctccgncgccgccctcgccctgcgtcnccgccggaaagtttgcaccgancccgatctggcagcgccgngaagacgagcggtcaccggngccngacccgagcgcgcccagaggacggcggggagccaagccgacccccgagcagcgccgcgcggtgagcacctgggccgcggccccgaggggacgttggggagtcgacccggtggggacagagaccgcggggcgggcgcggcgnggccgngggcgcggggagcggggagccggccgggcggtctccggggtccgggctggtgcgctcctcagtcccgtcagacacccccgttcccaaccccggctcggacaccacccggtcctgcaccgtcgggcaggtccaggggtctcagcccctcccccgttctctggtcctggggggcgcggctgggggcgggggtgtcgctggccgcctggcgccctgcggcggccacactgcagcggccacactccccactcagggccccgggccccgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcctcttccgcggcccacactggcgactttgaccccggcaagcgggtcactgccctgcccggctccggcccccccggcgccccaccacccggccgactcggccaccgggcttatgctccgactctgaaccgactgaccccggccccctcggcgcccgcatcctccaaggaccggccagggctgctctctgcccttggtattggggacatcagggttggggggtctgggtgcacccacgcctgccccgcccccacggggtgagggcgcagggatagggctttgtcaacagcctgtggcccctgatcccgccccggtgccctgaccttccactaccttctctggtttcacaaaaacatcccnggctcccatcccggagctcctcaaagcgtctgagaggccccttgcggacgccctgggagccccgctgccttcctggnaccagtggccgctccacccatcctgggggcccagctccaggtctgcgggtccctcagccgcccccagtgggaatcggtggagcctgacgcagccaggagcgcccaagagtcacgtgttctgccagggaggacatgggacaggacacggggtgccagccctgcaaagcggccggggcagtggagctcaggtggccctaagccctggtggtggctggtgtggcccggcaggcagctgtgggagggaggaagggggtggcatgcggtgggggtctagagaaggcgggcagggcacctcgggagcccccccattgggcacctcgggaaccccccacattgggcacctcgggaaccctcccattgggcacctcgggaaccccccacattgggcacctcgggaacccccgcattgggcacctcgggaaccctcccattgggcacctcgggaacccccntattgggcacctcgggaacccccacattgggcacctcgggaaccccccctattgggcaccttgggaacccctcccctaattctcagctgactccaaggcctgagaaggagcttggtcacctggactgtgaaggtggagggtggggtccctggtgggtcgtcccacctaccagctgtgtcgccggaagggtaatacggagcactgtggccccggggagccccgagtggcagctccacagctgggagtttctgtccactccttcagtcaacaaacattgatcctgggctgaccggggcccgggggtgtcagtgtctcctctcgggggagagggctgggtgagatcaacagaggagcctcccttcttcccttcaggctggtgtcaccttcagtgatggggcagggtccccacttgggaagttaaatcgtcgtccccgtcccaggaccacagcagcctcagncctnctctncaggccaggctctctcatgggtgctcagctggaaattggtccccccccggctccacccacccctgttggggtgaggagctggagtctcncctacccatatgggacccaccacccgcagggaacggaggacgctcacacttctgcacctcctgcctcactatcagagacccagtggagaattgcctccncacctcacctcttgtattcagaggccctgacccctnagggatccnggactaggggtgccctatggggagcccacctgtggcctgtggatgctgagctgtcgggggaatcctccaggatccccagcccnacnttnccaaccttctgttgaggctgaggggacacagagcccncactcctgggtcctgactgtttcaaagaaaggcctgggggactgggcagccaacccctccctcggctcgctggggtctccagactggctgcccggctggaaggtggggccctggcacgcgaggacctcatgtgtggaggcactggcttggggggtgctcccagtggctctagagtcaacatgacaggcatcgaatggctcctgtttctctgncagagttggggcagagccaggcttggccacgctgggctctaangggctgtcattttgcccagggagctcctggnctgggtggtcctccccccagggtgagcacgcgtcccccccacccccacttcgaggcgcccaggcagggaacagctcattggccagtgtccttcctccttgtcccccgcctgcatctccaccatccaccctgctccagctgccccttgtccctctccccgtcccctgcccagagccccaggtctcccctgcacccctgagcctgcccacctagcagtgcccctcgtccagggcccctctgggttgggggtgcacacagtnggggagaggcggctcctgctgctcctcacccagcccggctcagtggccggagccgcccaggacagtggcagtagatggggctgtttgatcaggatcagggaagataaggccccttgcgtgaccccagagctggggacgccaaaactgcccctcctcccccacccgcctgccgctgtctccgccagggagaggcccctactctgtgggtccttcgccccagcaccaagcctgcatggctgctcacctggctcaggaactggggatcagcgacacacgggtccntgcctcccatcggcccctacatgagcccagggtccaagggctgcggttgggagctctttagcagtctgtgacgcaggtgcctgtccctgtcattcagctgtcacactgncttggggcatctcaggccccgttagcggggcagccctgggtggagctggccccacngcgggctcacccagccgctacctggaggaggctaaaatccaggctgtcccgtggcagccagcagtccaggcctgcccggaaaccctctgctccagctgcagccttcgncccatctccttgcccctctccccggcttccccctggcactgccttccagctggctggccctccatctgcccagccatccatccacacctcttattccatttgagggtgccccaaagaagagcccgtaacagcccgggggctcatagccagccactcgcgggaccccgcacatgcacgtggacccacaggaagaccctccctgncttctcccnacagaanttcagttggtgcagaaactgggctctgtagcaacgaaaggccgatttgtgtagctgttgccaccccgaactcccagctcagatgctggctgtggcatggggaccaggggnctgtgactcccacagccctggcaggcaccacgggnggnatgtcctccccaccctgtgcccccaccnctaggccagctcctcctccaagtcgacgcccgcagtgctaacctcaaaggactgtgcagccagcctgtggcgtcccatgggatccaggaagcccaaccgagccttgcacggcacccacgaggcacctaggcaccccggtgctgggcagggggcacacatgtgacacagacccctgagtgtgggccccacacacttggcctnggcacagctgcaagccagcccagccactttgctcgctgtggcactggggccaagtgatggaaggtccaggcaccgccaccctcacgcttggcacattnggctcaggtcagcctggcaagccagctttcccaggggctaagaataggtgaggaggatggtgaggaagcagccgggggctgtcaactgagggaggaggtcaccatctggggaggctggtcccccacccaagagcattgggtcaccctgcaggaaggtggctgccanccagcaatgagacgaggggctctgcgaccctcagagctgccagccagccagccctgggtggcaagagtgactcctcctggggtctcctccctcctatcgccctctttttttttttttttttttttgagacggagtctcgctctgtcacccaggctggactgcaatggcttgatctcngctcactgcaagctctgcctcccgggttcacgccattctcctgccntcaagctcccgagtagctgggactacagacgcccgccaccancgcctggctaattttttgtatttttagtagagacggggtttcactgtgttagccaggatggtctcgatctccagacctcgtgatccacccccctcggcctcccaaagttctgggattacaggcgtgagccgccgcgcccggcccccagctccctctttatccctaggaccctgaggctcagaggggcagcttcaggggaggacaccccactggccaggacgccccaggctctgctgctctgccactcagctgccctcggaggagcgtacacacccaccaggactgcattgccccagctgtgcagcccctgccagatgtgggaggcagctagctgcccagaggcatgcccccctgccagccacagcgacccctgctgctgttgctgctgctgctggcctgccaggtgaggactcacagcaccctcagcacccaggggccntcctgtgaggactgcacactgatggctctctgtctgcctgcctgcctgcctgcctgcctgcctgtctgtctgtctgcccgtctgcctgcccatctgcctgtctgtctgcctgtccgtctgtctgtccatctgtccatctgcctatccatctgcctgcctgtctgcctgtccgtctgcctgtctgtctgcctgtccatctgtccatctgcctatccatctgcctgcctgtctgtcggcctgcctgcctgcctgtctgtctgctgcctgtctgtccgtctgcctgtctgcctgtccgtctgcctgcctgtccgtctgcctgtccgtctgcctgcctgcctgtctgtctgcctgcctgtctgcctgcctgtccgtctgcctgtccgtctgcctgcctgtctgcctgcctgtctgcctgtctgcccgtctgcctgtctgtctgcctgtccgtctgcctgtctgtccgtctgtccatctgcctatccatctgcctgcctatctgtctgtccgtctgcctgcctgtctgtctgcctgtctgcctgtctgtctgcctgtctgtccatctgcctatccatctacctgcctgcctgtctgcctgtctgtctgcctgtctgtctgcctgcctgtctgtctgtctgtctggttgcttgntgcatgtgtcccccagccacaggtcccctccgctcaggtgatggacttcctgtttgagaagtggaagctctacggtgaccagtgtcaccacaacctgagcctgctgccccctcccacgggtgagccccccacccagagcctttcagcctgtgcctggcctcagcacttcctgagttctcttncatgggaaggttcctgggtgcttatgcagcctttgaggaccccgccaaggggccctgtcattcctcaggcccccaccaccgtgggcaggtgaggtaacgaggtaactgagccacagagctggggacttgcctcaggccgcagagccaggaaataacagaacggtggcattgccccagaaccggctgctgctgctgcccccaggcccagatgggtaataccacctacagccccgtggagttttcagtgggcagacagtgccagggcgtggaagctgggacccaggggcctgggagggctcgggtggagagtgtatatcatggcctggacacttggggtgcagggagaggatagggctggaggactcacccgggaggcagtgcctgggttcggatgagggaggcagccaccanctgggcagaggggggcaggtgtggcagcctccattggngcagagggagcagnatgtggcagccacaggtttggcgatgcacctgggaanggatgaaaatggcattngggttcagcccccagagagggaggtgctgagagaaggtcacngagaatggggnanccnnntgnnnnnnnnnnnnannntnnnnnnnnggggtctnccaagggaaggtgtcctncagagntgnanttcagggctggnctgggcgtgctagcggagnctngtccagnggaggnggatnntcaggtgaggaaggtggaggtcagatgggngaggtggaggtcaagtgggggagggagcagcccaggccatgtcctgggcgaggtgacggccgagctcaggcttccagagagaggagagaggcnnncnnannnannncnnnnnnnnnnnntnccctgccctgctctgccctgccctaccntaccctgcagagctggtgtgnaacagaacnttcgacaagtattcctgctggccggacacccccgccaataccacggccaacatctcctgcccctggtacctgccttggcaccacaaaggtacccatagaggggaggaactgtggggggggcgggcccagggtggggctgacncccangcctcccccncnacnacncncccagtgcaacaccgcnttcgtgttcaagagatgcgggcccgacggtcagtgggtgcgtggaccccgggggcagccttggcgtgatgcctcccagtgccagatggatggcgaggagattgaggtccaggtcagtgggcggcaggcaggcgcggtggggctggatgggaacgggcatgggggcccctgcctggccctcacaggccactgtaactcgcagaaggaggtggccaagatgtacagcagcttccaggtgatgtacacagtgggctacagcctgtccctgggggccctgctcctcgccttggccatcctggggggcctcaggtaggattccgccagcgcccggggcggccgcagaggacagggaggaggacgggcgctgactggctgtgcccacagcaagctgcactgcacccgcaatgccatccacgcgaatctgtttgcgtccnttcgtgctgaaagccagctccgtgctggtcattgatgggctgctcaggacccgctacagccagaaaattggcgacgacctcagtgtcagcacctggctcagtgatggagtgagcccccctcggcggccccaggcaggtgggtgnggtgggcagccaggcaggtggccangtagccgcgctcacactgcacctgtaccaggcggtggctggctgccgtgtggccgcggtgttcatgcaatatggcatcgtggccaactactgctggctgctggtggagggcctgtacctgcacaacntgctgggcctggccaccctccccgagaggagcttcttcagcctctacctgggcatcggctggggtgagtgggctggcatgagagggggttaaggcaggctgaccaagcctttgggaccancagctgctgccccccacaggtgcccccatgctgttcgtcgtcccctgggcagtggtcaagtgtctgttcgagaacgtccagtgagtatgagcggctggacagcctggggagggaccggggggctggggtgcggcgctctggcctgaggcagggaggggccggggatgagcctggtgcctggggagggggtcatttgtgaccttctcccttccttttctgagaccncgaattagatcctggcaaaatcgggacgggggtgctgaggggcggagggngctgggggctgtgccccnagtatgtgagtggcctggcctcgncangntgctggaccagcaatgacaacatgggcttctggtggatcctgcggttccccgtcttcctggccatcctggtgaggaaatgaagagccaggaacgcaccccaggcccctcctcccttggcgtcctgaggctgccccaggagacagcagcatcctgtctgagagcgctgggagggagccggcacccagacaggacaccaggacactggccagcaccctggacactgagccaggctgttcctccctggctgtgtgcccaccagccccagggctatgtggcccagggcctatcttgctgccaggcccacctgcaggagggtcaggtggggccttccaagggcacagagctgttccctggggctcgggatgcccctgactcgcaccctntctcacacagatcaacttcttcatcttcgtccgcatcgttcagctgctcgtggccaagctgcgggcacggcagatgcaccacacagactacaagttccggtgggtgccgcggcagctggcgtctcgagacctggagaccctcagggccagagggcagctgggggtggggactccaagctccacgtggatggtgcgggccgagggtgggggcggtgggtgactcaggcgctgcctctgcaggctggccaagtccacgctgaccctcatccctctgctgggcgtccacgaagtggtcttcgccttcgtgacggacgagcacgcccagggcaccctgcgcntccgccaagctcttcttcgacctcttcctcagctccttccaggtgnccgcncgcccgccggctcccccgcccggggcgcagtgtgccacccctgaccaccctgtctctccagggcctgctggtggctgtcctctactgcttcctcaacaaggaggtaggtgggagtgggggcatctgagaccatcagcactggccgtcggggtcaggggcagagagaggcacagggatgccagccccacccctgcccgggggttggaacacgtggggcccaagcctttccctccccctgctcttattgggtgcagttgccatggcgctgggtgtcaggcccccaggacaggttggcctcagccccatcgctacggtgtccaccgtngggggtccccaggtgtctgcagactgctttccgtggcgatgctgggtggcatagctgtgcccagcagggagcttgtgtcgctctgcacccctcagagcggagactgggcatctccgatgaggcccacagcaggtcccggntggggtggangnanggacagngcaggccctaggactggcctgccccgtccccctccccaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagnagggcgtcgctggacaacccagaactggacgcccagctgaggctgggggcgggggagccaacagcagcnccccacctanccccccnacccccagtgtggctgtctgcgagattgggcctcctctccctgcacctgcnttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaangtggtcacncgtgcatgtcntggaaagcagggctgganaatgctggggccgaagcnagtgggggatggaacagncggtgggtggtcagcgccagtgcgggctgttgaagggtccccntgctgtcccagttcactcagagttggcactggaaccccggaggatccngaaggcagccagcctgtgcccatctgagcaggtcctggccaccttcccatcntggttctggcgggcagtccccctggacgctttggccaccagagggtcaccattcaccagcagagacntgaggggcacagtggctaaggcggcatgaggcatcacagtcccctgaccgaccccatcagcactggattcacccgagggcgtcttctccctggaggccgtgaggacactggcacctggctcatcggcccgcccttcctctgagcctcctggcctccgtttcatctcagctccagccccctcgggcaatttacaggccacgtagcagattgaagcgggaagaaatgggcctgaacanttgccgcgggtccaggcgacggaggagggcaggttgcccaacttctgcacaggacccggggtgcgccacacacacgccagtcctcgtgccacacagagaggtccggcctacgccagtcctcgtgccacacagagaggtccggcctacgccagtcctcgtgccacacagangaggtccggcctacgccagtcctcgtgccacacagnangaggtccggcctacgccagtcctcgtgccacacagagaggtccggcctacgccagtcctcgtgccacacagagaggtccggcctacgccagtcctcttgccacctcgtggtgggtgggcgccctgcttgccagccagggagcaccaggaaagagctgcctcctgcgtgctggacacaggaggtgcttcagggtggggtctcccattgtgtggggcccaacctgagtctaagggcccagggaccacacagcgggggtggagacaaattcagggtagaagctgtgaggggcctgtggtcagccccccggggggtccctgcagcaggcactgtgagacctactgaggtgtgtgcatgggctggggaaggagccagtcaggtgcccctgctctgaggagctgctgggaagtgctgctgggccctgggnggaaggggtgctcacagcccctgcctgggccacgtgggctggangccgctcaggcagagccggactaattggggcaaatganggggacaggaggcctctgaggaaaggtaaatagaattactcacccgccaggcactggggccctcctgggggggccctcanccctgccacccaccacagggcctgcatgcagcagggagggaagtgagctgattaggcaaggctggacccttctggggccctggggttgctgtgattgggancggcaaggccaggagacggtcccctgagctgcacctgctggaggcctgtgatctcagaccttaaggcttcaggccagctctacgcccctccggcctcaggtcctggctctcctctgagccctggatgcccngggtgcctgtgtgggcacgaggctgctccgagtcagcacacggaggtggacattctccttcatgccagctgagctcagggctggtgactgccctggggaaactgcccctcacctgggacctcctgacagccctccccattcccgagtccctctgcccttgtcctctttcacctctgtcccgccctcatccctaagggaactggagcaggctggtggagttgggtggagttggggactggcagggggtggactcacccaggcaataaacactggccctaaccaggcagtcctgcaggcaggtaggtggagggactgttttttttcttttttggagatagagtctcactctgttgcccaagttggagtgcagtggcatgatcttggctcactgcaaactccacctcccaggttcatgtgatntctctgcctcagcctcccgagtagctgggattataggcgtgtgccacgacacctggctaatttttttttttttttttttgagacggagtttcactctcgttgcccaggctggagctcaatggcgcgatctcagctcaccgcaacctccgcctcccaggttcaagcgattctcctgccttagcctccntagtagctgggattacaggcaggtatgtgatgcccggcatcccaaaggggtatctgcaagagttgggtgctgtgtgtgcatggctgggaggaagatgactttgataccctggaatncntggtgtctgtggacacaaaaatactantaaaatgagagtggagaccaggaaaaanggaagacatgannctacatgaaggaccaaatctaggagagtcagaagtgcgtcacaggaataggggaccttgagccagacagaaggctcagcagagacaccctcaaggggatgaaagggattgagtgcactaatatttagaggagagagttcaggacttgattagtgactagtacatagaaaactaaacaaatgaggctgggtgcagtggctcatgcctgtaatcccagcactttggggggccaaggcgggcgaatcacctgaggtcaggagttcgagaccagcctggccaacatggtgaaacctcgtctctactgaaaatacaaaaattagccgggcgtggtggcgggcgcctgtagtcccagctacttgggagcctgaggcaggagaatcgcttgaacctgggaggcggaggctgctgtgagccaagatggtgccattgcactccaccctgggtgacagagcaagactccgtctcaaaaaaaaaaaaaaagaaagaaaaaaccaagcaaatgaaaaaagaaggcaattaataattccaaagaaaagaaaaatttgggcagaaaagaacaaaacaagcagaatttaccatgactcagttctgaatacaaacacagacatcataatgtaaacaccaacactgatgcaaccagaatcatgggagaaaaanagatctagggagggtggtggacgggaatatcacgtatgtactgggggtaggggagagaacaaaatgggaaaaatcaagaataattcacgttagaaataaaaatacagagcaaaatttaaaaatgcaaagaatgaggtgaagagttcaaagtggtcanccntcggggccngggcgcggtggctcacgcctgtgatccnagcactctgggaggctgaggcgggcggatcacaaggccaggagtttgagaccatcctggctaacaaggagaaaccccatctctactaaaaattagccaggcgtggtggtgggcgccngtagtcccagctactcgggaggctgaggcaggagaatggcgtgaacccaggaggcgcagcttgcagtgagccgagatcgcgccactgcactccagcttgggcaacagagtgagactccgcctcaaacaaaacaaaacaaaacaaaaaaacaaagtggtcatctctaggcaaggtgggtgggagatggctagggctgcaggtccactacgtgagctggctcagcctatccccagacaccctgcactcactcagcccggggtcctccccctgcactcactcagccccgggtcctcccctgcactcactcagccccgggtcctccccctgcactcactcagccccgggtcctcccctgcctgctctttctctgaccctgccctccactgttcctttttcttctttctctnccctgttgtgtccaggaaccaggcaccaccctcatttcttctntgatcaatctttaaaaaccagcagtgctcagctaactcttcatctatctcccccgacctggggctctgctgaatccacngctttagacccagctatcagctcggcatgtacagctggatgtccacaccgagctgctcaccctgtccccagcttcttcctcccactgtccactgcagaagcctcctaacaggacccctgctgctaccccggaccctgcaacccattcccacacagcagccagatgctttgacacccgaagtctcctatgaatccgatgaggcctctgcaccacancctcanttttacagaagtacaggggaaacaggggtctgttgacaccacagagatgcagctggccaaaggcagaantgtggggtacacgactgtcaaacgccaggggtccttacacgaatggtggaaaaaganggggcatgttacggatggaggctcgggacacatgggcgccgccttcccatgctgccagcaacccaccaggnaacctattaatttagtcatttgggaaatgggagctgggtatatcggctattaggaaattgttcatgctcaataagtattaattacaattttcataagagcttaacccccctgaaagaggtcactgtttcctcacttgtaaattgggatactaaaacctgccccatggagttgccagagtgacgtgtgtgcgtgcacaccaacagtacacagcagatagtgacatatgtgtgcacgccaacactacacagcagatagtgacttgtgcgtgcgcgccaacactacacagcagtgacacgtgcgtgcacaccaacagtacccagcagatagtgacatgtgtgcacgccaacactacacagcagatagtgacttgtgcgtgcacgccaacactacacagcagatagtgacatgtgcgtgcacgccaacactacacagcagatagtgacgtgtgtgcacgccactacacagcatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacagtacacagcagatagtgacatatgtgtgcacgccaacactacacggnagatagtgatgtgtgtgcacaccaacactacacagcagatagtgacatgcgcgtgcacgccaacactacacagcaggtagtgacatgtgtgtgcacaccaacagtacacagcagatagtgacatgcgcgtgcacaccaacactacacagcagatagtgatgtgtgtgcacaccaacagtacacagcagattgtgatgtgtgtatgcacaccaacggtacaacacgcaacagttgcagttgcctcatttccncaagtcgccctcactgcagaaaggggagtgtctccagctgcttagtccagcagcctccaggattgggtgagggtcggagggccctggtgccctgcatggacaaggcagtggcagcagggctgaaggacaggctggggtgggaggaccgcaaccctctgggatcgggccccacggtcagctcccgcagcccaggggagaggtgcccactctagcagccctttatgtgctcctcaagctganaagtagagaccccgctttgtgactacagtgagttctcacaccattaggcgaatggctggngtaagaccaccctgtggcccctgcagagctgacctcactgggtggtccaccgaagaggggatgggagggcaagtttnnnnnnngnnnnnnnnncngnnnncnnnnnnnncncntnnnnngcncncnngtaggttaggcccccntctnccgcgtcccctncccctcctcaccccaatncccatcccccacgcggtgcatcgggtgaaggggtggggnnnnnnncancacnnnnggctcagngctncccacagnctcntaccctcntgcccagcangtgcnntgnccagnccggncccctcctctgaagggtncttggcagaangatctccaaatngaaggtttctggtggcaggcccaggtgctggggccatacctgggggagctccaccccccggctgtaggtaggcaaggcccggattccagggnccagtgtaagatgacccaggtgagcccaaatcaggtccatctcttaacacaaggagctccctcggcacctcctgtgtgctacacaggggtcccagcacccatgcaggggagaggcctttggatcaccacagcccacactctgtacagagggataaactactgctttgcctgtagagtagccattcttttatttatttttttctttttcttttttttttttttttttttgagacgngagtcttgctctgttgcccaggccggagtgcagtggcgcaatctcagctcactgcaacctccgcctcccgggttcaagtgattctcctgcctcagcttcccgagtaactgggattataggtgcctgccaccacacccagctaatttttatgtttttagtagagacggggtttcaccgtgttagccaggatagtctcaatctcctgaccttgtgatccacccgcctcagcctcccaaagcgatggaatcacaggcgtgaaccaccgcacccggccctaacttttctatttttagtagaaatggggtttcaccatattggccaggttggtctcaaactcctgaccttgtgatccgcccgcctcagcctcccaaagtgctggaattacaggcgtgaaccaccgcacctggccccttttctttaataaatttgcttaaaaaaaaaaaagaacccanaggctgggcacggntggcttacgcctgtaatcccagcactttgggaggccgaggagggtggatcacaaggtcaggagagtggctaacacggtgaaacccntgtctctactaaaaatacaaaaagtcagccgggcatggtggcgctcgcctgtagtctcagctactcgggaggttgaggcaggagaatcgcttgaacccaggaggtggaggttgcagtaagccaagctcacaccattgcactccagcctgggtgacagagcaagactnctgtcntcaaaaacaaacaaacaaacaaacaaacacaccaaaaaccagaaaacccagaggggtaaattgaggcaggctggccgtgtgccaggccccagactgcagagcccagactccccaccgaaggctgagggtcgcgcttgctgtgtgaggctcagcaccttngtcaangtgcacccnacacggtgactcgtgggggtagcagcaccaagcactgcgccacccatgatgtagtcatcaccacctgaagaaaccaaggctgactccaacctgctcacagccacggtgtagcaatggcctggccagggnctcaagcccacccctcctcctcctgggaatctgggaaccccatgtttgagtgggccccccactgcaggacctctgctggcccttgcagctaccactgtacagaaggtgcacagggcagggccttgtccccaagaggctcggtgagtggaaggcacatggcatgaggaccgctgtgagccgcccgcccctcatccccgtggtggtgttccccaggctgcatcggctcaacagggggaggcagcctgggtcaccctagcctggtgggcactcgaaacgctcctcgaaggactcacaggccccatgggggccaggtaaggccgtgtgtttacagggagttggctcggggctgggtactgctgtgcacactggctgccaggcggcagctgggctggtttattactggaacaccctccccntgctcnctcctccccggggaggccagccctgcgccagcatctcnctgcaccagcccacccaccaggaggcgccntgtggggccactcttctgggaaagcgtngttcctggaataaattctggtttcgcttccaacaggaacaggaatagagctccctgtctggcctgccagggcagcttgcaggtttgaaggtcaagtgcacgtggctctctcctgggcccagcggcacccccttcttctggacaggggaggagccagctcctagaggggccacagtgccccagagggtgggttcagggtggtgcctactacctctgcggccccctgggcagcccctgtggcagaacaagggtagtgatatcaggcagcccagcctctccctccagaatgccctccctgccaccacctgccctaggagacctgagcacgcccagtggcttagactgagaatttctgggcttgagaagccttcgccatgatctggggtttccagccctgcccgggagctggctgtgcatgtgtgccgcaggggcagaggcctgacagaccaccaagaggccacgcccagtgccgccgcctttattcacagaccctcgagctccacagccacacagacacttagctttcagagggcacaggaaggaaaagggacctggtgaccctcccagcacaccccagagccaagacagacccagcagcagcacctcagggtcagcctgggtgcccctgcccaggggccactgtgaccgcagacaccaggaggccaggcctggttgctggggacccccttggggggcccggcagtatcctaggcccaaagagctggtgccatcttgaagctgattcagggaangaggccaggctggacggtaggggtaggtgtgagaagctccccagcgtgtccaggccacgggagcagcaagggtctgcggggagccnaggctggatggggtggggctgcccttgtcctgtatcctgaccacttcaaggacaaaaccagcccagtcccagcagcntgggaggcagcagaggctcnttcttctcccctcctgatcctgcagtggccaggggcaggagggtgaggggagaggagagaggtcagngtcagggcccctgggggccaggcagcttcaaaaatgcagccaggtggctgggggagggcaggagggtgggcagggcccagacccccatgatgggggcagcctgagacccccaaggatgaaggaagggggcttgggaaggagaggcaggcctcagccgtcagtcacgccagtgctgggatctgcagcccgctggagcaaggcacccccatcccaggggcaggnaccacaggacaggagggaaccgacacctcgcaccctgatcttccggaggccggggaggggcaccgggcgctctaggacttcttggcatcctgcgtgctccggcgcttcanggtcactcaggtcgatgggctngaaggctgccaggggacaacgcggtaggntggtgggcacaggcccctcctgcccatgaggcccggcctgccggcccagccctgcccccaggtcagcccccactcactcttcaggctggggttagggaccttctccacatactcctccaccaggccccgctcgccacccggcacctggcctcgcaggtctcgctccacaccctgccaggctgcagaggcagagagtggtgtgctcagggccccctgccccagggggtggcatccacgtcacgagagtgcctgccctcagctcctgccctcccagatcctcttctccctcagaagtgtcctccatgctcccccacagccctctgncccaccccagcctcactcacctgcagaccccgtccccgctcctctggcaggcctgtcccttccccgcaagatgaccaggactgtggtcagagggacccctatgaccctaccccaggcttccctgcgcctcggaggcagcgcatcctcctcagctaggcctctatctttcccacctcatccacgcacctccccggccccagcacacggcacactcccctaatcccagacaaccacctcccggccacttctgcaacacgcccgttcatggctggatgcgtgcctgtctgtcttcaaagngcccctccctttccccagcaaactcctccagtgctgctagcatggatgactggctcccagtgcggcctctatctgtggcatggcccacccccagcccctcctcccgggctccccccatgatcagaaccaggtctcctctctacacaaggtcccctcggccacccctacccgcctgggccctgaaggctgtggacacagtgatggggctatctgtgccctggaggggcaggggcaggggccgcaggaggttcctcggagcgtgggtcctgggctgggggcagagctgactccgtcaaggacagggcaggagctgtgtgtggcaggcgcacccaccttcgtaaatgaagcggacgttctcctcgtgggctggggtgaagatctcgnctgctgctgggtggggagcgggggctgctggtcctcttgccgttgtacacgactctggagacgggggnagctgggggagcctggcgcatgagacagggcacacagcagggtgggagcccacaacccgccccggtggagaccagcccacctgcctgagacccacctggtcatcgcgggggcgtctgatcctagcgctccaccgccagatcccctcagcctctgaaacagaagccagcgcaggcatgggacgcagggccaccctctccagcacagaaggagggggaggcgcagggcacacctgcctcctncccnttcagatgtgaacaaagtgcatggtccctctgcctaccagggtgtcccccacaggctggggtccagccacaggcagccagtgggctccaggcaaccctacgaggtagcagagagctggccagacgagccagacacacacacaacttgaagcgatcaagcccgctcagcggccttgatcctccacgtctcaggctcagacgtggaggcctcagccccagcaccgggagcactgtggccagagccncctccccacgtngggctggtggggccgtcagcatctctgatgtccagctgcctctcactgcagcagagggcctgcagcccctcagctaactgaccctgctctccctggtgcagggctgggcacacggcttctgctgagccttgatttcctttctgtaaaacggggatgagcttcctaaaggtgatcccagctnccccggcacctacccaggtccagcttcctggttccctagagcatgagccacatcagtaccctggagatggaaccaaactccagctcccctggtgggcagagggggtggccctggaggaagctgctgggcctgacctggtgaccaagaccctgggctgccgcccgtttatggcctcccagcccaggggaatccacggctctggaaaaatggagtctattttgaggctcagacgctcacactgngcaggctggacagtgtccccactccagctgaggacacacananccccaaggntggggaagctgacagggnctggtctccagcctgccctgctccagangggggcaactccaggttctgggggaggggagtcccaggattcccaggagggggctttgagcacaagcaactcccctgcccacccagaggcccaaggctgcagatactccagggcacacggctgcagccctcacagagggccaggagcactgaggcttcgagtcctcntctggctcattccgcctcatgtcaatggtccagccctcaaacaccacgtgataagaatcccacggctcaagggcaaaaccnagcaaagagcagaaaaccagctcccagccctggaactctgtgccccatcccaggccaggagtgaggtccaaaaagggccaggggctccccacccacggcagcacccagtttgctcacaaagtcacctctcctttcttggactctggggtctctctgcccagtcnctcctgccagggactccagcccacgaacaccagnagcacggagnggaaaggcctgtttgggttgagggtcccacagggacatgctgcctgctgggaagctcccgttacagagaaaggcagagctcaggtaacaggtagactggccagccccctgcctcgccccctgctggctctcaccactgaccgactgctgctttaggggtacctgcctcccagncctgccctctcccgtggctcttctccccatgcatcctctgcctccagtggccacttggcctttatgcagccacacctttggcctgggatccccctgctgggttcggttgtcactcctgccccagatcccactgattgccccacatcctcccaagcaactacccttccggggctccctttgccttgtgtgcacacacacacacacacacacacctgcccacacatacctacctgcacacaccttagctgaatacatctgccancacacatgcatacaaccgcccgcacacacctgtctgtacacacctgcccacacacatgcggcacacacccatatgaacacacctggtgtggcagcatgcacttgtagtcccagctactcagaggctggggtgggaggactgcttgagcccaggaggtcaaggctgcagggagccaagatcgtggcactgcactccagncccaggcaacagagcnaangacnccntgtgtcaaaaaaaaaaaaaaagcccaggcacggtggctcacgcttgtaatcccaacactttgggaggcagaggcgggtggatcagctgaggtcaggagtttgagagcagcctggcgaancatggtgaaaccctgtctctactaaaaatacaaaanttagttngggcgtggtggcaggcacccgtaatcccagctactcgggaggctgaaacaggagaatcgcttgaacccggganggtggaggtgcagtgagccaagatcgcgccaacgcactccagcctgggcgacagagcaagactccatctcaaaaaaaaaaaaaaaaaaaaggccaggncgtggntggctcacgncctgtaatcccagcactttgggaggccgaggcgggtggatcacaaggtcagngagttcaagaccagcctggccaatatggtgaaaccctgtctctactaaaaatacaaaaattanctggatgtggtggtgggcacctgtggtcccagctactcangaggctgaggcaggagaagtgcttgaacctgggaggcggaggttgcagtgagccgagatcgtgccactgcactccagcttgggcgacagagcaagactccgtctaaaagaaaaaaaaaaaaagccaggtacggttgctggcctattaaaataggcctgtaatcccnacactttgggaggctaaagagggcanatcacttgagcccnagagttcnaaaccagcctgggcaacatggcaaaatcccatttcttttatttatttatttatttatttatttgagatggagtctcgctctgctgcccaggctggagtgcagtggcgccatcttggctcactgcaagctccgcctcccgggttcacgccattctcccgcctcagcctcccaagtggctgggactacagaagcccgccaccacgcccagctaattttttgtattattagtagagacgggatttcgtcctgttagccaggatggtctcgatctcctgaccttgtgatccacccacctgggcctcccaaagtgctgggattacagtcgntgagccaccacgcccggccggcaaaatcccatttctacaaaaatataaaaactttggcaggagtgatggctgaggtggtaggattgcttgagcttgggaggtggaggctgtggtgagccatgatcataccactgcactccagcctgggtgacagagggagactctgtctctaagtaaataaatttaaaaccccataaatatatacacctattgtgcacccatacattttttttttttttttttttttgagatggagtctcgctctgtcgtccagggtggagtgcagtggcgcgatcttggctcactgcaagctccgcnctcccngggttgnacgccattctcctgcctcagcctctcgagtcgctgggactataggcgcccgccaccacgcccagctaattttttctatttttagtggagatggggtttcactgtgttagtcaggatggtctcgatctcctgacctcgtgatccatctgcttcggcctcccaaangntgctgagattacaggtgtgagctaccacacncncagctgcacccatacagttttttaagtcaacaaggagtctcgtttgcctcctcttgttaggaaaagaaatgtacccacaccctcaataccacaggctgtgtcctctaagtcttcccagacacgaagagcccttcccacctctccctacttcttcctccagcttagggacccccagggcctcacactgcccccccaccccccgaccctgcacacatagccccaggctttcctggatgtgccagcagttccaagaggccaggggcctgctgtccccctggaagcacaataaacggttctgcagctcattcagcctcactgcctcctggggccctgccaaggagctgggtgcccaattctgacccagaaggaattttccattaaaaatcaagtatctgtgcacaacctatgacccagccattctgctcctaggtacacacacccaagatgcgtacaaggacagctggagaatttcactcgtaattacccaaagggaagagccaccgcagaagggtagcaatgcacacctggcctattcccataagggaatcagcagccagagggggcaccacagcccccacgcagagacggacaccaagcacaagagcaggacctgaggggccacagacaggccctgggacacatgnaatgggaggaagctgcanagggccgaggcatggacataactggagccggggccaggacggtgcctgtgagggcaggaaggagccatccacggagagggctggaggtcaagcaagctctgaaccaagaggtcaccatggagccacaataaggcctccaacaacctcagcggggcggcctagcatagtgaggcacacagctgaggggggagggcaggaagtgtggctnggcaggcagctcagccctagctcaggcctgntgggcagcaggctggtgtctggctaagcagagggaaccctgaggcacaacatccatgcatggggtccctgaggtggtggatgtggagggacccagganccatagtgggtgagagtgagcaggggacaatggcacaggcccagagaagcgccgggggcagccggaaaagacccagcacacggcagacggccacctgaggtggcagcccctgagccagcaggagactgacacctcagctgcccaggtaaaggggagtggcggcctgaccgaggccgaccacaggtgaagggtgggagggaggggctccattncnnngnnccagagagacagccccacttcagaggtctcgagaccccatccagcccggccccctgccttcatcccacctgggccaccaccagggtgacagcagtaagggagggtcaggcgatgcctcggtcccgttttccttccctctttctgtcagaatcaagaccgagcatgccgatgtcccggccacggccccgtactcctcagtcgctacaccacaccccactgcctctgagagttttctttcatagttttcatattttaacatctttgaaactgggctgcgcctgacaattgctaacacgtcagaatttaaccaatggtggtttttatttctcaatgtactgtaaaatatagcgcagctcacaatggctggggtctcacatgggaggaccctcgatgacactctcctggcccanggaccacccttccagagcccctcaggctacatggtctttaggtgttttctccccttcccctcaaagtcttccacatcccacgccaccccaccccacccagtgctgggacaacctccagttccagacacccagcatcaggacaggtggacacagatgtctacatgatcttcctgaaaccctatccccaagtcacttagcactagggtgtcacccaggccctctgctgccatcaangcccactgtccagtcccaacttgttttaccaggtgtcacctgctgctccactcctgccccaacagcctttgccacaggactacctgccaccagccacacagagcacaggccacctgcaagtctgtgcattctgcaggacgtgactgcctgcttccgtggccgtccagcctacagggcctggcctactgggctgcaggtattcccctgctctggggccccgggcaagctcctctgagcctcagcatcctcattcaaagtgatgcnagcccacaggtaggnctcgcctgctccaatagggacggaagcacagccatggaaagccagcagctcagtgaggtctctgtggctccnttatccnatacgatgatggacaggacaagcatgtgctgtatggttcaactggatgctgttaagaatgaaaggggctggggccaggcgtggtggctcacgcctgtaatcccagcacgttgggaggctgaggtgggcagatcacctaaggtcaggagttcgagaccagcctggccagcatggtgaaacccncgtctctactaaaaatacaaaaagtagccaggcgtggtggcagtcgcctgtaatcccagctactcaggaggctgcggcaggagaatcgcttgaaccncgggaggcagaggttgcagtgagccaagatcacgccattgcactccagcttgggggacaagagtgagacttcatctcaaaaaaagaaaaaagaaaggggctagatgtggtggtaatcctagcactttgggaggtcaggagttcaagactggcctgggcaacatagaaagagccccatctcgacncaggtgcggtgactcacgcctgtaatcctggcactctgggaggctgaggtgggcagatcataggaggtcaggagtttgagaccagcctgggcaacatggcaaaaccccattgctactaaaaaaaaanaaatacaaaaattaggccaggcgcagtggctcatgcctgtaatcccagcactttgggaggccaaggtggaaggatcatctgaggtcaggagttcgagaccagcctggccaacatacagtgaaaccccatctctactaaaaaaaaatacaaaaattagctgggcgtggtggcacatgcctgtagtcccagctacttgggaagctaaggcaggagaatcgcttgaacccaggaagcagaggttacagtgagccgagattgtgccactgcactccagcctgggcaacagagcaagactctgtctctcaaaaaaaaaaaaaaaattagccaggcatggtggtatgcacctgtaattccagcttctcaggagtctgaggcaggagaatcgctttatacccaggaggcgcaggttgcagtgagcagagaccatgtcactgcactccagcttgggaaacagagacagagcaagactctatctcaaaacaaacaacaaacaaacaaacaaaaaagggccccatctctgctctctgccctcaaaaaaaaaaaaaaaaaaaaagaacgaaagggatgctgttgattatcaagaatgaaacaactcttctgggtaaactggaatgtagagtcagcccactcttaggaaggtggaggcccagaaaagcactggggactgaaagaagagactgccaccagccacagcaaacacttgtcgggctaagggcagggcagccaccacgctgggcccttacacacattgcccacatccccacagctggaccagaaagataccctgagaacttccagttcagcgctgaaggagcctgccaccaagcagcggtgcccctcccagggcctccggggccacagcatttggggctcagcccgaatgctgcagctggcctgagcctcccaaagtctgcctccactcntgcctgcaccctancagcaggtttctggactccctgaaagacccactccctactgatacccatgtggctttgctcagagactggcccntccctccagatagggaggggagtcgcattgggtagaactatgtagaaccttcctcctccaggggacccaagggctttagagacttccaggtggggaggggacagaaccccagtctctggcctcccagtcccaaattctttcccccacacagccacatgcctaagaacaggccatgaggtaacactccagcaacgtgacaatagtgaggttccagagttagaatcagtgacgccatcgctagtcaccatgctcctccggagtttctgagattcaaagtttctaagactccactttctcttcgtgttntgtgtctttttcagccaacgaggctagaaaatgatctattgcccaagcaggcgcacgaggatacggntgtcacagctgccacactggcacctcgtggtcccttgaagaccgcccagggaaagcctctaagcgctgcaccacctcctcaccctctcccctgggtggtggcagcaacagcctgagcgtgtgcgccctcctccccatcctgatcccactcaaaccacaacctcccntgactcgccccaaatccagccctgttggctcttccttcacgtcccacttcccaccctctctacacgttctcgccacatcccacccaaagtccactcactggtccctgtttacacctcagggcctttggtcaagctgtcttctctgcccaaaactatcctactcatccttggggatccagctgaaagaccancttccngcgacngctacccangggcaggagggagagaagcacagcccgtgccccgtatggctcccgcccccgcggtcacaaccaccgcccagtgagtgcctanaaggcaggcggaggccccgttctccccgttaggcccagcatcaccgcccggggagacgggaaagagggcaaggccnaaaaatggacagaaaaagaatgcggacggccgggcccgcggcgctccgagaatcggaggcatcctcaggnacggtccctccaggagaccgggaaagcggggctctgtcagccccnaagccccgacggcggcagaaggctggcccgctgcgagcgtccggcggcgctgggtccccggcacctgcccctgcctgggcgggaaaggcgctcagtccgagccgcgccctccccacgcgcgctcccaggcgccccgcgggccgcgccctcctgcaggtgccgggcggggaacgcgggcccctccctcggaccccggctgcccggccactcccccgcgcncggncccgcccggccctgcanggnacccgcggccgcgcggcgacaccanggcggggnccagncgngnccgncnngnnnnntnnngnntcnngnnnnnngngnngntnnnnnnnnnnnngnnncnnnancnnnnngnnnnnnnnnntncnntnnnnngnnccnncnnnnngnnnacnccncnggnnnnnnnngnncnnnncnntnnntnnnncnttnanannnnnnntnnaananggnnnanncgnnnncnnnncctnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacacatccctgtagaccattgactggcccataggagtcttagagcggaattaaggctccgattattcctcctttcgtcggagcagcagtatctgagaagagaggaaggcacttccctcccaaaggccctcctagagtgatctggagaacggcgacgggggaagtctcagaaatcacaggcatggtcaggcagggtcccgaggataagagcggcatagtggggaagaggtaggcaccgtagcctgcttctcagcggaacagtcccgcgtggctcgagtgggccggcggatgatgcccggccacctcagagtgcctcagcggtaaagtcgtccactacgagcatatgagtgtctcgagaggccttggagacaccgggggacacgcgccctccgctagttgcagagggcggtccgcgcgcccatgcctgtgatcccgccttgcggaacagtccgaaggggcctcccccgcccggccgagcagtgcagctgaggccgcgcggcgaccagagggcgggggccatccgcgcctgccaggccccgggtcttccggggccaacgggcgctgcacgaggatcaccttgccctgtccaggccgccaccgcctcttnnngntnngnnnnnnngnnngnagtgnngccaccgngggctgcacaggngcaggcgcagcgcnntctcacgtgnccgcccggctggcggagggcgggggcggccgggattcccgtgcggggttggggctcgtggcggaagctccggacctccctggcccgaacggtgagcgccgccgnccactgggagcggccagagcccagtaatcaggacaccaccacagggaccacgtgtgtagacccaggccccctcacctgggagtcacgtttattgaaaaagtaaaaagtgtcacagtaaaaaattcacctggggacaaagccaggcctaggaggggtggcggggtcgtggagggacgggtccggccgcccctggcccacgggtggggcacgtgctggcccatgggcgacgcgcggcttctccagggaggcggccctgggcgcgggggcgggcgggcaaagctggctcagtccatcgtggtccctttgaagagctccaccagctccttgtagtccgggtcgatgaggtcggagggcaggtcgccatcgtcgttggttgcatccctgtccgctcccagggagataaggtacctggggtgtaaaggtcgctctggctgaagcggggaggagccaggagagtgctcgccccaacccgggtcagagggccagagtcctggggtcacctgtgtgtcccccaccttggggtcctaaggtccgggtagggtgaggaggaagaaacctgaccctttggaagctgtggccagcttttcaagttggttctattgaggacaaaggcagaaacaggattccagaagcctctagggtttgcagggttcntttttttgttttttttgttttttgagacnagaatttcgctctntatcacccanggnctggagtgcaatggcatgatctcgactcacggcaacctccacttcccgggttcaagtgattctcctgcctcagccttgagtagctgggattacaggcgcgcgccaccacgcgtggctaattttgtatttttagtagtgagagggttcttgtcacgaactcctgaccntcaggtgatccgcccacctcggcctcccaaagtgctgggattacaggcgcaggcgtgagccaccgcccccagcctctagggttcttgccgacaccacccgggctacattttggggctcccatcctggggacccactgaggcccggaggggtcgggttcaagcctgtgtagacccagggccccctcacctggctatgtcagggtacccatcgctgncaggcaatgtgcaggggtgtccagcccgcctcatctcgctggtgaatgtcagccccgtatttgaccagcagcttcacgcattccnanggttnccagagagcacggcttcatgcaangcngccaggcctgggcagggaggacgggaggggtcaagactnngccccaggtcaggtcctccttgctggcctctcccaccaccccacaggccctggccagctcttccaggctttgctcacctgaggggtggatggtggccagggagactttccgagtccggatgaagcgccccacctgctccaggtcaccctgccggatgtggtccaagaacaggacatcattagggaaacgcacgctgcgatcagccagcatccgccgccgccgctgccgtgggctgtagcgggcatagcgggcagttctgctaggcatcttgggcgctgtggggcaggttgcccctggggaccctactgcactggggttaataatgtatccggtcccgaccagatcagcttgagggctcctgtcggacgagccccggcctctgacttgcttatatagggctcaggggctatataaagctgcacggtcatcctccccggcgcgaggggctgaaactgagctgcacccccgccccgcaccccagatcatgtttagtgactcatctttcagcccatctgtcaccgtgcccggccaaaggggtcagatcattcctgcctgtcgctccctgccccacagnctggacctagaaggtgccttaccgagggcaggaggaggcaccggtgcagaacccatgagatagctaggaacgcgagatcaagggcacagtaggtaccaaggtcattggaagggcttttgctctctacctcctggaaagtgaggggcggccnaccccctccacatctgcagaagcacaggtccaccgtgctgtggtgaaacaggccttagcccctccatctcccntacctgtcnagttttcaccttccagcgtggcttgcctcactctcagtggttttcccaaaactactctgatggcctaggcaggcggatcatgaggtcaggagatcgagaccatcctggnctaacacggtgaaaccccgtctctactaaatatacaaaaaattagccgggcgtgatggcgggcgcctatagtcccagctacttgggaggctggggcaggagaatggcgtgaacccgggagngcggaggttgcagtgagccgagatcgtgccactgcactccagcctgggcgacagagcaagactctgtctcaaaaaaaaaanaaaaaaaaaaaaaaatgactctgatggtgctgcctcctgctcagaaaccccgcaggcatccttggctgggatctcagtgcctcaggctcctgctcagtcagtcctgcgacttttcctccacgtgcctggntcccctgcctcacacacctgcaggggacagggtattccctacacactcatgggttcaccctgcatagtgtctctgcattccaggtttgacacacatactcacacttaaggtggtgtccagtttgctctccacgttcagggaccatcacaccctgggtggtgtgctctctctgccccggcccctgtgatcttacctctagangcacagccaagggaatttttttgtttgtttgtttgagtcagagtctcactctgtcgcccaagctggactacattggcgcaacctcggttcactgcaacctctgcgtcccgggttcaagtaattattttgcctcaccttctcgagtagctgggactacaggggcatgcaccaccacgtctggctaatttttgtatttttagtagagacggggtttcaccatattggccaggctggtctcaaactcctggccttgtgatccgcccgcctcggcctcccaaagtgctgggattacagacgtgagccactgcgcccagccaagggaatttttaaaactcgtgttccaacaggctcttcattgctggctgcctttacttttgcaacagccccagtggaggtccaaagtagggcttggactacaggacatgagnaagtggatgggatgggacacagacacagagttgaccagggaggtctttgttgtcagggacagcgatcgattgtgctaggagcactgcagcacttgaagctggatggatgagtctgccggggctgtcttcacagaccacagantgagtggcttaaaaaacagatggttggccaggcgtggtggctcaaccctgtaatcccagcactttgggaggccgaggcaggtggatcacctgaggtcaggtgttcgagaccagcctgaccaacaaggtgaaaccccttctctactaaaaaatacaaaaattaggccgggcacggtggctcatgcctgtaatcccagcactttgagaagccgaggcgggtggatcacgaggtcaggagattgagaccatcctggctaacacagtgaaaccccgtctctactaaaaatncaaaaaaaaaaaaaaaaaattagccgggcgtggtggcgggcgcctgtagtcccagctactcaggaggctgaagcaggagaatggcgtgaacccgggaggtggagcttgcagtgagccgagatcgtgccactgcactccagcctgggtgacagagcaagactccatctcaaaaaaaaaggccaagcgcgttggcttacgncctgtaatcccaacactttgggaggccanggcaggtgnatncacgaggtcaggagatcgagaccatctggctaacacggtgaaaccccatctctactnaaaaatacaaaaaattttctgggcatggtggcaggcgcctatagtcccagctacttgggaggctgaggcaggagaatggcgtgaacctgggaggcagagcttgcagtgagccaagatcgcgccantgcactccagcctgggcgacagagcgagactctgtctcgggnaaaaaaaatacaaaaattagctgggtgtggtggcaggcgcctctagtcccagctactcgggaggctgaggcaggagaattgcttgaacccaggaggtggaggttgcagtgaactgacatcacaccactgcactacagcctggggatggagcaagactccgtctcaaaaaaaaaaaaaaaaaaaagacggtccgtcccagagctctggaggctgaaatctgggatccgggtttcagcagggcaggttcctcctgaggctctgaggagcgtctgtcgcaagcctctccccagcttctggtgccgccagcaatcctggtgtccttggccctagcagcatcgccacgatctcggccttcatctccatggtgttctcccagcctttgtcactgttcacatcacccccttgtataaggacaccagttatagttgggtattgcctcatcttaaccagtgacatctgcaagcatcctgntttccnaacaacggtcacattctgaggtcttgagggctaggacttcanacgttaattaaggagacacatgagtcaacccataatgctggtaaaaccctgcaggtggtcactaaaggcctgaatgaggacagaaccaagactggccagcagctctttgcaggggcagaggagagctgggccaccaacagcctcgcatcattaggctgatctgcatccaacgaaatcaaatcagcaaacatattagacacctctaggtgcaaagccttggccaaatgctatgggagggctgggcacagtggctcatgcctgtaatcccagcactttgggaagccaaggctggagggtcagttgaagcgaggggtttaagcagcctgggcaacatagtgagactccntttgctttaaaaaaatttaaaactggccgggtgcagtggctcacacctgtaatcccagcactttgggaggccgaggagggtggatcacgtgaggccaggagttcgagatcagtctggacaacatggnagaaaccccccgtctctgctaaaaatacaaaaattagccgnatgtgngcggcgtgcgcctgtaatcccagctactcaggaggctgaggcagtagaatctcttgaacccgggaggcggaggttgcagtgagccaagatcgcgcgactgcactccagccntgggcgacagagcaagactccatcttaaaaataataataataaaaaatttaaaaaataaaataaaaagagtaaaaggaaaaatgctgctggagaagcggcgctgacggagggtccctgcctggcgaaatttcctggacctgcgttggtacccaggtgcaccccctgtcccctcccctgccccctgggcccctcgcctcgggtacaccacctctccagtcacacactggagtggccctggagcctctagccaggcccgggcctgcagacaccctgaggggggtcggctcccagcgtggctgcatttctagggactcagggaaaggtatggacagttggaattccaggtcacttgggaggagccaggccgttttttctggcttgtttacgtgaagcctggagacgaaacgttgtacactggagacaggctctcctctgatgtgaagattgccttttctcatgttgtggaaagttctgtctgccctcccccctcagaggatcagatgaaagcacgctggatgaagctgccaccaacagtgtgacgagaaggaacgccctttccaggagtgaccgggcctcaggctagagacgcggtgggggcaagaccacccggtgagcctgtttggcgaccccaagcaagcccctgtgtccctcctgctggaggtgagctgggagcgtgcagagcttttggctttggggtttctatctggatcacccgagggactggtgcctgaagcctcgccagtcacaacagatttccttgaaaggtatttatgtgccttctattctaataaggatgtgggaaccgtgtgttctacgccatgatagacactccctggagctcctcacccttgaaacgttccatcagaagccggccgtcagcagtcgtgcctgctccaccgtgggcgaagcgtgctgttcatgcagcgtgacgtcagagccaaacctgtcttcatggagttttgtccctgattncttcttggtccatatgaacttgcaaattgacctagtttgcatgactctaagtttctgccttctggaggacgaactagaacatctgatgcacaaggtttaccatcnnantttntntattttttttnnnagacggagtctcgctccgtcgcccaggctggactgcagtggtgcgatctgggctcacggcaagcttcgcctcccgggttcangncattntcccnnctcagcctccngngtagctgggactacaggcgccngnccaccacgnccagctaattttttgtattttnngnagnangacggggtttcnctgtgttagccaggatngtctctatctcctgaccncgtgatccgcccgcgtcggcctcccagagtgctgggattacaggcgtgagccaccgcgcccggcctaccgtccaacttttagaagtccagtgaggcctggctgggctcagaagctcacgcctgtaatcccagcactttgggaggccaaggtagaaggatcacttgaagccaggagttgaagaccagcctgggcaacatagggagacccccttcccttcaaaaaatttaaaaattagccaggcatggtactgggtgcctatggtcccagctacttagaatgctgaggtgcaaaagattgcttgagcccaggagtttgaggctgcagtgagctacngtcncnccantgcaccccagcctgggcaacagagcaagaccctgtctcaaaanaaaaaaaatgtncngtgaatgcanccagcagtgctctgcaaaagcacccgggagaccctgttagtaaagtcagctgaggccaggcgcagtggctcangcctgtaatcccagtactctgggaggccaaggtgggtggatcaccngagatcaggagttcgagaccagcctggcnancatggtgaaaccccatctctactgaaaatacaaagattagccgggcatggtggtgcatgcttgtaatcgcagctactcaggaggctgaggcaggagaatcacctgagcccaggangcagaggnttgcagggagctgagatcgcagcgctgactccagcctgggcaacagagtgagactatgtctcaaaaaaaaaaaaggaaaagtcagcgcaggtcgcactgcagtctggcaggagggccagcctagggccagaagggcccttccctccctgagngtcagaggccccccggggtgtggtacatagacccagcaatcactgttttaggctccaggccggtggcttcctggcacctggagagacagagggttgggaagtcccaggctgctaagccctaaccnacctcctcccagagccttcaaagtctccccactaatccagcagcccagtcagagaggttttggacactgccccaccacctcccagccacagccgagcccaggaatgtgctcatcagctgcctctgcaaaacgggaaaggtatcagtgactccctcccctttccagagcacatgacaccagtgctgcgggcagctgtgccatgtcccaacgnttctctccagagggccggctccccgcacagctggtccacagggtcactgcaccccatcccnacggccagggagcacaggcacaaatacagcccacccctttagctgtgactcaggacagcctccctcagagaccctgcaaggagccacagccctcgggcctctgcccacatcctcccacggcacctccagatgccgttgcccacttttccgtgagtacgcggctcactgtgtcgcaggacccaggcatggcacacaaaccctgctgaggccctggagctgaactagccnagaaaccagccccagcacgggctgtctccaagacccacagagctgggggccggggcagacggcagcacccagactgccgagctggtgtgagccgtgtggggccaaggacatgtgggcaaaccngggctggctggtgctggcgacgtgttgacacaggtcctcgcggcatgctggccggatactccacagcctggagcagaggcaggaggagccggagcggccgagtttgtgagggcctgtggggccggcaagggaggtagcggggagaacgggagaaccgcacccccggcgaggcctggtctggcttgagagccgtctctggctccagcagctgcagccagcccgcnaangctcgggaactgggaggacacccgggaantctcggcagtgcggaagctcctactctaggaagcacatcaggatgtgaagttggcggggctcacagagtcacaggcagggctcnctcaaggcagcctggtgagggtcgtttgttccatccgaacttctgagggccgagcagcctccctagagctgcagctccacccccnacntncccacctgccacctgcacccttgggctccttcctcctgcctcaccgccctctgagaccaccatgagccctgctggatcctcagggcctctgccgttgccctcagggggacccacagacaccacagagctcctgttgcctcccctgcagaaaagcagcaaatccaggctcagcagagccatcgcccagccctgcacacaggccgcggcttgccgtctgcagaaaaattgactttcagccgggcgcggtggctcacgcctataatcccagcactttgggaggccgacgcgggcaaatcacgaggtcagccagcagatcctggctaacacagtgaaaccccatctctactaaaagtacaaaaaattagccgggcgtggtggcggatgtctgtaatcccagctactcaggagngctcangngcaggagaatcacttgaacccngggaggcggaggttgcagtgagccaagacagcaccattgcactccagcctgggccacagagcaaganctccgtctcaaaaaaaatcgagtgtatgtgttttttctgcatgtgaagcacaggagtgctgaggttaagccaaattnacaacttaaagaccaggagatccttatttttagagacagctctgtcacccagctggagtgcagtggcgcgatctccgctcactgcagtgttgacctcctgggatcaagtgatcctcctgcctncagcctcccgagtagctgggactgtaggtgcaaaccatgcccagctaatttctaatttttcctagagacggggtctccccgtgttgccccagcactgggattccaggcgcgcgtccctgcgcccagccctgccctttatcgtgtgaagggttagtgataagcagggccccctgttcctctcacccatccttgaagcctgagtccacctgatttctcgtcactccacggcggggatgggagggaatgaccaggagtctgagcatcacatggggctgggtggctccacnccgtgtccacatccnagggtccagaatcacagaagccccatcagagtccaggtaaagcagcctacaggncagggaaggcatcctccccngggaantcgcaagcctgcacagctctgctggggagactggggcctgtttctgcatctgcacctcgtcccaggggcgaggcctctcagcaccagtaaccccactaaggcctggcagatggccttggcgtccgcattccagcccagctctccgggcttggtgagatcataaacccgaggcaaggacaggtggtaaaatttcaactttatttggccaatgtgttcaattcgattgtgaaatagaaatgcctgaagaactgtcagcgtctgattcagctccagcatccttggccacctccccacccgggagtcaagggtcgtggttctgccttgaacaggccacaggccgtgctgtagagaggccagtggtcacaatgagcccacgacaggaggaggagccctggcttgagggaaggggaaggcccaggcctgtgccgggccccagggctggcagccaccagcntcctcttccaggcatgggggacaccctgacaggatccggaagtctccatttacccaaaaatgcaagagccatgatcagtcatggcgacactgcaggcggtactgagtgaccatgtccagtccggctccgtccctcccacacgggggacaagcttctccgaggaggcctggccaaggtggaacaaataccctgatgtcgaaaaatgtctaaaaatcccacagacggaattttcaaaaagaggaganaacctcccgcgggagggaggcagcgagactccgaacacgngtagcaagcactctggacagactcatgtatgaaaaagtacatcatggtttcaggaaacaagccccaccagggtgggctgcctggagatggatccctttccaaaaaccgaaaagcagaaggaagagacgggggtgaacggacggtgtgtanggggtgaggtgtcacttcagagaggttccctgggntttccggcgacgccctccttcaagcgaggccgcaggcttcggaggcgtgcgctgctgctgggtgtgcagcccccgaggggtctcggcagcgcccgggtnctggctttgcgtattacagttcatctttcacagctttctgatcatcgtcttcctccatgtctggctcctctgcttcttccaggtcctcgagatcctgggatacaggaaaaggggcggggcgggcaggttggctgcaacagctgaggctgccggcccccnagcaccccacactgctcacaccggggactagccggccacggcggacatggccaccggccactggagcagccaaccctggtctttacgagctacacaggggtcttcccnaggaagagtgacgcctgggggatttctgcctatagcaggatgaatcagagcccccactgtgtcaggaaccctgggaatcccagctcagccttggacccttccactgggcatggaaggcgtatgtgtgtctcccagcttggcaccatggagtctacagagggtccacatctcggcagggacaacagccccagcatgaagtccaggcacagtcaccactggggtgtgaccattctacttccaacccttgggctctggccaatgacaggccacaggcagcaccaggggccggccctccatccccagcctgggcagagtattcccacctcccactgtgcaccagcactcccagcaggccctgccagcctgggctgaccatgccctcatctccttcaccatggtcaagcaccccgcccctgccgcatcctcccaacaccagcncttcctgcttccccggcagagtcaccactgcntgctggccacgcgctgacgggcaggactaaactcccgagggcagacccatgtctgcgcccttgtgcccgggccccgccagcgggctggggatggacctctgagtccaagttagcagcatgtgaggaaccggtgccatgtgtctgaaaagngttttctaagcaaaatctggtttttaaagatgccttcaacgtcgtcccctaaagaagtgctggccagggagagctgtttcagcagagcactgggagcacatcccttgccctgctgggcgnaaggtgtnggggccccagagccctggacgcacagacgtgcctccaatggcaccattcccatcacaagccgagcccaagtgggcatgtcccgtggggccaaggggctgaatcccagagaccagcccagggctgtgaccccactcacgtcatcatcccctgccccatcctggccaccgctctccanggaatttcttaaaaccatccagcgtgcgttccccgttgtaatcaatgacctgtggaagacagggatgagtgcagggngctggtcccggcccagagccaatctcctggcattggctcctcctccctagagaaaggcagagcaggcccggtccgngtggctcacacccggaatccagcacatntngggagttcaaaaacagcctaggcaatatagtgagatcccatctctctcgaaaaacaaaggtgggtgcttctgaaggagctcccacagctcttctccncacctgactagccccaggctccttccagagaggcacccaggctggcgtggggaccactgctcttcccagagcccgccccagccccgtctggagggaaggcgcaccgtcctgtcggcactggcaggaaagaacttgagtgtggggaagctgtgcactttgacggcctccancctcgttggcagtcgagtccatcttggcgatgacgatgttctcatggtccttgtacgtctctcccagtttatcccaaatngggagccaactgtttgcagtgacncacaccatggggcatctgaaaagaaagcagttctagggtgtgtcctggacacaaagccactggcagacgcttccccaggagtctgcctaccttgcgcgtgccctggtggcacggacctggggagctgaaagggcaacacttacagaactccacaaagacgttttttttctcatcaaaagccacgtcttcaaagttcttcccaacaagcaccttgacaggctgcttgtcccagtcctccggcagctcctggctcatcaggtggggctggagggcaggcagggcacggtgaggggcggcgatgcctgggggaccacagagctccccaanccctcaccctgcccgggactgaggtgcgtggctgccctgggcacaccagggtggcagccgcagacaccaacagtgccaagaatccagaaagagaaggctgggccagtgggctgggcccaatgagcccacgcaggccgcaccctcgccggccaggaggtttccctgaggagcatctgggccagccgtgtggacaagagggctcctacaggtccccaaaggtgtgacaagaatggtggtcttcacaccatcttgggctccgtcctcttactctgaangatcttactttgaggacgaagcccaggacactgagagcccagagaccccaaggtggcggctctacccgggaggcagccnctggcccggggacgcgcctgcaccttgattttgccctccaggaangcggtggcagaactctgtgatcctctctgccgtcagctcctccgattcgggcttgtacttnggtcatctcctccntcncagggntgatgaggcgcacggccgggcactcttccttcttcanggccaaagaactcgaggatgcgctggttgtcggtgtggtcgctgtcgatgaagatgaacaggatctgggggagaaaaggaggttgcacaggntgcgggagacggctggcctctgcctccagccctgactttgctcggaagcagaccgtgctccggtgcctttttcctccaacctggattccggggttgcccaaccagaccagcaggtgactgggagcagaggtctggcctggnctggcccctcgcctacatccaggctgtcctgaatcaggtgcccgatccagtccagcaggcagcctcaggaaggccccacacttgtcacctcgggaagagttgtactgctccctggcaccgccccacgagccacccagaagagcagctcaccttgcccttgaagctctcggctgctgttttgaagttgctcagtttgccgtcatagtcagacacactcttgggcaagaacagcaggatgtgagtcttgatttcacctccaaaaatcttcggggctgtctgtgttataaacttaagttactgggtctgagtcacacactattaatgcagaagattctcccaatggcctccaatgtcagacgctggacagcagtggtgaccgggagcctcatgccaccccnnaacccactcctnccccatccccagcctgggggctgcagggcagccgcacctgctcggtgaactcgatgacaaggggcagctggttgtgtttgataaagtccagcaggttctccttggtgacctccccttcaaagttgttccggccttcatcaaactgtggacagaaagagggccctgactgagcattgctgctgggagcacagcccctgggcccgggtctccctggacgtgggaagtcacagcagccagcagccctgccctcccgtggggtttcgagccacaggtccagcaatgggtacaggacatggctgttcctcgacagtaagactggctctggtcacggccttatggctgcccgtgaattcaacagctggcttcacatccacaatgcaagcctggcgcacgtggtcctccagcaaccttgaagtgtggcccatccccagggcccctagccttttcagggcacccatgtggtcaaagctattttcttttttatttgtttttgagacagtnctncgnctctgttgcccaggctggagtgcagtggcatgatcttggctcactgcaacctctgcctcccaggttcaagtgattttcctgccttagcctcccgagtagctaggactacaggcgcctgccaccatgcctggctaatttttttttgtatttttagtcgagatggggtattaccatgttggccacgaaggtcttgatctttttttttttttttttgtgatggagtcttgctgtgtctcccaggctggagtgcagtggcgtgatctccactcactgcaagctccgcctcccggattcaagccattctcctgcctcagcctcccaagtagctgggactataggcgcccgccaccaccggctaatttttggtatttttagtagagatgggtttcaccacgttagccaggatggtctcaatctccttacctcgtgatctgcccgcctcggcctcccaaagtgctgggattataggcgtgagccaccgcgcccggctggtcaaagctattttcacactcacacttctctggcctctgccttttcactctccctctcacgtgctgcggcacagacccacagaggctgctgggcgcatggtgtcgcaagagcaggagggcaggagaggagaatcctgctggaggaatctaaaacatcactcagcactaaattgtttttgtctgggacaaactagtttccgtaaagatgtgatttatgataacatgtaatgggattattattcttttaaaataaatttggctacagtggctcaggcctgtaagcccagcactttgggaggccaagatgggtggatcgcttgagaccaggagttcgagaccagcctggccaacacggtaaaaccccatctctactaaaaatacaaananataagnctgggcgtggtggcgggcacctgtaatcccaggtacttgggaggctgaggcaggagaatcgcttggacccgggaggcggaggttgcggtgagccgagatcgcaccantgcactccagcctgggcgacaagagcgaaactctgtctcaaaaaaaaaaaaaaaaaaaaaaaaaaggccaggtgcagtggctcacacctgtaatcctagcagtttgggaggctgaggcaggtggatcacttgagttcacgagtttgggaccagcctggccaacatggtgaaacctcgactctaccaaaaatacaaaaatttagctgggtgtggtggtgcacacctgtaatcccagctgctcgggagactgaggcagaagaaacacttgaacccgggaggcagaggttgcagtgagccaagatcgtgccactgcactccagcctgggcaacagagcaagactnctgtctcaaaaaaaaaaaaaaatacaaaaatacaaaaatcagttngggtatggtggcacctgcctgtaatcccagctacttgggaggctgaggcaggaggattgcttgagtctgggaggtagacattgcagtgagatcgcaccactgcactccagcctgggtgacgagtgaaacaggccaggcgtggtggctcacgcctgtaatcctagtactttgggaggctgaggcgggcggatcacctgaagccaggagtttcagagcagcctaatccaacatggtaaaacgtcgtctttactagaaatacaaaaattagctgggcgtggtggcgggtgcctgtaatcccaactacttgggaggctgaggcaggagaatcgcttgaacccaggaggcggaggttgcagtgagcccagatcgtgccactgcattcgagcctggcaacagagcaagacttcatctcaaaaaataaaaaataaaaataaatagagagaaaaaaacgattttttacattcttagttctagtttctaatacaacagatcctgaaaggcgcaatccacgtgcctgtaanggccctggggacccctaataatgcacggcagcttcagggagtcctaaggccacaagatggagaggctgtggcgccccaaccacgaggggtcagcctgcagctgaggatgcggcctcggctcaggctcagagaggcgcccctgtgctgaggctcttcaagtgagaattttgggtgagccttccatcattcccccgaactacttttttatttatttttaaaatttatttatttttttattttttgagacnggagttttgctattgtcacccaggctggagtgcaatggcatgatctcggctcactgcaacctccacctcccgagttccagcaattctctttcctcagcctcccgagtagctgggatcacaggcacccgccaccacgcctggctaatttttgtatttttagtagagacagggttttaccatgttggccaggctggtcttgaactcctgaccccaggtgatccacttgcctcggcctcctaaagtgctgggattataagtgtgagccactgagcccggcccaaactattttattttttttttgagacggagtttcactcttgttgcccaggctagagtgcagtggcaggatcttggctcactgcaacctctgcctcccgggttaaagcaattctcctgcctctgcctcccaagtagctgggattacaggtacgcgccaccacgcctggctaattttgtttttttagtagagatggagtttctttctnccatgntggtcaggctggtcttgaactcccgacctcaggtgatcggcctgcttcggcctcccaaagtgctggaattacaggtgtgagccactgcacctggacagaactactttttnaaatacttatttatttaatttattttattttattttatctattttgagactgagttttgctcttgtttccctggctagagtgcaatggcacgatctcgatcttgcctcattgcaatctccgcctcttgggttcaagtaattctcctgcctcagcctcgcaagtagctgggattataggcatgtgccaacacgcctggcaaattttgtatttttattagagatggggtttctccatgttggtcaggctggtctcaagctcctgacttcaggtgatctgcccgccttggcctcccaaagtgctgagattacaggcgtgagccagcgtgtccagccaaaaaaatttattttatttttactttttgtagagacagtcttactatgttgcccaggctggtctcagactcctggcctcaagcaatcctcttgtcctggcctccctaagtgctgggatcacaggtgtgagccaccaagcctggtccccttgaaccttttttttttttgagacagagtcttgctctgtcgcctacgctggagtgcagtggtgcttctcggctcactgcaagctccgcctccntgagttcacgccattctcctgcctcagcctcctgagtagctgggactacaggtgcccgccaccacgcccnggctaattttttgtatttttagtagagacggggtttcaccgtgttagccaggatggtctcgatctcctgacctcgtgacccgcccacctcagcctcccaaagtgctgggattacaggcatgagcccctgcacccggcctcctcaaacttcttaaatgagacttggggaaataaatcacgcatcctttcttactggnccgtttccatgtatgcgtctgcagagtaacttagagaccaggtgccactccctgctcttgtgcacgctgtgcctgggccaccctggcctggcctgactgccaaggagctgatgttaaaccagggcacaagcaccaaccaccctgcccgaacccgaggggcagaggcttctaagcctgctacctcttccccagaggggcaaaggcgggtaaggagaggcagaaaagccaagttcaggaggcccttggagggaatcctttggaacatgagctgctgatcacagccgtgctcccagtggcacgggtgggctcgcactgtgcccaggagtaacgccgggccgcaactgcaggcaaacgaaatccccccacccctgcagaacaatgtctctgactccctccagagtgtcaggcgccgcctacaccatctcatgccaagaagccaggnaggagacactgccgcagctgtcccagggctgccatcgtttcagcagagatgctacaccacactcaatcacggtctactgcggtaagggaaactggtccacttagcagggcacagcagcaggaggccagccctgccaggccacgngtgacaaacagcatagaaacgcccaatgcaggccgnggtggtatggctcacgcctgtaaccccaatgttttggcaggctgaggcaggaggattgcttgagctcagaagttcgagaccagcnctgggcaacnacggtgaaaccccatttccacagaagtattaaaaaatagccaggtgcggtggtgcacacctgtggtcccagctactcagcaggctggggtgggaggactgcttgagcccaggaggtcgaagctgcagtgaagtgtgattgtgccaccgcactccagcctggtaacagagcgagaccctttctcaaacaacaataacaggcccagtgctgccagctgggggagaagaaaaagtgaaatatcagaagctctcacacccatggtgccagtgaccagcagcccccgcagaggttttcctgggttgcagtgcctgctagggaaggaagggaagagcaggcaagagcgggccacacaagagcacccgactcagccaggctgcccactgtggccactgcacacacaggaaggcctcactcactttgagggatgggggttaacagcctggtggnaaaaggaacaagttggactcatcctctcagctgcggggtgagctctgacttccagggcagcccctaccacgtgcaccggacagggggccgggcttctgcccggagctgccntgcaacgaccacgttcgccatcacagacacctgagccaccttcagtgggcaggaaagcgccacccaccaactggcatcaaacccaagtgggtttgtctgtgcccagctctagtggactccagagaatggagacagaacgttaacctgtggggagcccacatggatggccacgtgtgagcctttgcaggcaagagcaacgaaaccnaccctcccagccttcgcggacacatatcaccaaanctgtccatagagtcacagcggccactgcagacatccagggcactgaaggagctgtgggctgtgtgacaacacagnggttcgcgagtttcgtgggctctggagaaagtctgccccagaacccaagtttcanggacaagacttggaactttctctttaataaaagctctaaaaagacctttggttccttcaactttatccaacacttcactggctttttctagtcagaggtttaatttcctgggcaccttgcaatggcaatagactaatttagcaactctcttcccttcaggggacatcaagagaatgtctcctggtaaagagcatctactgtcttgagttatctntgaggaagtggctgcnaaaacagctaaatgacaagaacaagaacatggaagcaagccatcctgacccacccgcaccaccgcgctccaggaagctggctctaccctccctcctacctggtcccggggagtgctggatgctccgtgcttactacagaaagtgaatgggtcggtggctcacacctgtaatcccagcactttgggaggccaaggcaggcggatcatgaagtcaggagttcgagaccaccctggctaacacggtgaaaccccgtctctactaaaaatacaaaaaaattagctgggtgtggtggcgggtgccctgtagtcccagctactcgggaggctgaggcaggagaatggcgtgaacccgtgaggcggagcttgcagtgagctgagatcgcgccactgcactccagcctgggcgacagagacagactctgtctcaaaaaaagaaaaagaaaaaaaaaaagaaagtgaatgggttccttgtgtccaaaaccactcagccccaatcccagaggctgcccgtctgaccgtttggcttatgatgctgctgtctaaaaggttcttctcccctctggaaacgacacangacaggagctganaggtccgatcgcccccggccgccctncctgcccctcactccccaggtccctcctctcccgagactttctctcctatccacactaccctggctctgagcggcacaaacccaccatcacccacatccaggttcagctgtccctagagcacaagtgtgcggccccagccccacctgcctggtgaccgagaaaagagacaatagaaacccacaggccccatcttgacactgtgcaaacaaggaccctgctgtgtcctggtaacgggnagnngcgnnnaanangccacactgtccaggagcccttccccagnagnaaggacagcgggatcangatggcagttttnncacagtggatccttangggntcataatgcccttggggctgaggggcatacgaagtgtgggtgccacctgggtgggaacacgcccagagcgccaatactccagacctctgggtaaggaaaacgttctggaaatagggatgctgcaggacgctctgaatgtagttaatactttagaatagttaaaacgtggccngggcgcggtggctcacgcctgtgatcccaccattttgggaggctgaggcaggcagaccactcggagctcaggagttcaagaccagcctggacaacacagcaaaaccccatgtctaccaaaaaatacaaaaactcagcccagcgtggtggcacgcgcctgtagttccagctgctcgggaggctgaggttagaggatcacttgagcctgggaagcagaagttgcagtgagctaagaatgcaccaccgcactccagcctgggcggcagagtgagaaaccctatctcaaaaaaaaaaaaggcaaacggggccaggcgcggtggctcacatctgtaatcccagcactttgggaggctgaggtgggtggatcacgaggtcaagagattgataccatcctggccaaaatggtgaaatctcatctctactaaaacaaagattagctgggcatggtagtgcatgcctgtagtcccagctactcgggaggccgaggcaggagaatcacttgaacccaggaggcggagggtgcagtgagccgagatcacgcaactgcactccagcatgggtgacagagcaagactctcccaaaaaaaaaaaaagggcaaatgttgttacatgnttttatcataattgaaaaaaaaaaaaaagctaacagtcaaaagcagttctgaggcggctgtggcaggagagtggccagaaagcccacagctgaatgcgaagaccaggccacaggcatcagcgcaacaccccaacttggcaaagctgcagaacatacctattgggccaaaggtgccaggagcaaggttcccttaacgataaggagagcaacgccaccctctgcagaccaaccccagaactaacctgggcagagctgcctggggccactcaccttcttaaagaggacaaccccatctttgtcgagctggtatttggagaacacgtcactgttggaagtgatcccaaatggtatgtcatcgatggcctctgctgcctgcaaaaactgcttggcagagtccgactccacgtcctgaatgaggnagggagaagcagaggtcgtcatgatcccgcagcaccaagcagtagggcagaccctgtagagcccaggccaggggggacacgtgcagaactgccagctgcaggctgtggacccctcctcaatggatgacggaaggaaggaagactggaatgctctggtctctaccttgaagaagccgatgacagccacctcgnctggactccaccaaggactctgcagctgcgccgtcaggcagggtggtggcagccgggcccgtgcgcttcttcagccagttcacgatgtcatcagcctctctgccagctaaccccaaacaaatgtaggttctactctcaaacagggagtgccgcctgccctgccgcgcctgctcccgtctctgctctctgccagccaggctgaggacacctgaatcaacctaagtaagatgttctcccaccatggaagaggcccggtgccgtccgcccgcctcctaaaccccagtgtacgtgagacntgtggttgtgtttatggggagtggagangggaangagnggtgattctgtctctgaataacaggatcacaaacccattttttttctctgatctctctgcattttcttttttcttttgacacaggggctcactctgttacccagctggagggtagtggcagaatcttggctcactgcagcctccacccactgggctcaagcaatcttcccaacctcagcctcctgagtatctggggtacagatgcacgctaccacacccagctcatttttgtatttattgtagagacggggttttgccacgttgcccaggctggtctttaactcctgtgctcaagcagtttgcccaccacgacttcccaaagtgctgggattacaggcatgagccaccaatcccagcccttttttttttcttggaagacagggtcttgctctgtcacccaggttagagtgcagtggcatgatcatggctcactgcaacctcgaacttctgggctcaagcaatcctcctacctcaggctcccaagtagctgggaccacaggcatgtgccaccacacccaactaacttttttttttttttttttttgaggcggagttttgctcttgttgctcaggctggagtgcaatagtgtgatctcggctcactgcaacnctccacctcccgggttcaagcaattctcctgcctgaccctcccgcgtagctaggattataggtgcccgccaccacacccggctaatttttgtatgtttagcagagacagggttccccatgttggccaggctggtctcactcctgacctcaggtgatacacctgcctcagcggtctcccaaagtgctaggattacagaggtgagccactgcgcccagcaatgtttcttcttttttttttttttttttgagacggaatctacctctgtcgtccaggctggagaatgcagtggcgccatcctggctcactgcaacctccatctcccaggttcaagtgattctcctgcctcggcctcccaaatagctggtattacanggcgcccgccaccatgcccagctaatttttgtatttttagtagagacggggtttcactgtgttggccaggctggtcttgaactcctgacctcgtgatccgcccgcctcggcctcccaaagtgctgggattacatgcgtgagccaccatgcccggcncnaatttttctattttttgtagagatggggttttgccacgttgcctaggatggtctcaaactcctgggattaagcagtccgcccacctcggccttccaaagtgctgggattaccgggnatgaaccactgtgcccagccctagctaatttttgtattttttgtagacagggtttcaccatgttgcccaggatggccctctgcattttaaaaattttattttttgaaacgaagtctcactctgtcacccaggctggagtgcggtggcacgatctcagctcactgcaaccttacctcccaggttcaagggattctcctgtgtcagcctcccaagtagctgggattacagacgtgcaccaccacgcccggctaatttttgtatttttagtagagacgggggtttncaccatattggccatgctggcctcgaactcctgacctcaggtgatccacccgtctcagcctcccaaagtgctgggattacaggcatgagccaccgcacccagcctgtcctctgcgttatctaaattttctttgacatgtacatccatcaaacacatgttctcacccaggagtctgacagcaggcctcattttagagaggtggacagtaactcaaaactcagtgccagttttctacctctgggaacaggctgacgccccgcccacctgactcccgcgcctcctaacttatcccaggcgtttcgggagttctcgccaatggcccaccctccatgcctcccagaccaggaagaagatgacacancttttatgccaccaaaggcggtcaactgacaggaaagaaacttcctcctcctgggagactgaggctaaggaatgatgcctctcctttttccctcctagaacttgactccctggtccgaatcgggaaaaccccattcagatgtagaaggattccaccagtgctaacaagacggtcaccagtgacaagtggatttaggagtgctcatctcatctgcaaacctgagtgttagtgacagaaccacggtgactttggacagagcacttcccgttccaaaagtgaacatgagtaaaaaatgagaacatcaatcacgcctgtaatcctagcactctaggaggccgagacgggtggatcacgaggtcacgatcgagaccatcctggccaacatggtgaaaccccgtctctactaaaaatacaaaaattagccaggcgtggtggtgcacacctgtagccccagctactcaagaggctgaggcaggagaatcacttgtacccgggaggcagaggttgcagtgagcagagatcgcaccactgcacgacagagcgagactgtctcaaaaaaaaaaaaaaaaaaaaaaaaaggaaacatcaaaacagccaagtgagaggcaaccacagagctgctgccactagaacaggacagggcacacctgcttaaggggacaaaaggaaacatcaaaacagccaagtgagaggcaaccacggagttgctgccactagaacaggacagggcacacctgcttaaggggagaanccctgctaacactggaatgagctgctttcgggctacccancatgagcatctgacatgccacagaaccggntttatagacgagttttcntttgccaccgtcactgatctggctacacaggggctcggcctccactacggcagcttcagaggcggcagacgagcagctgagggcccgtgctacagacggagcagggcgggcttggattcgaggtctgctaccgacaggctcgatgctgttactcagctgctctaagcctcagccctttgtctgggaaaagcccgcctcacagagaggatgcgaggagaaatcacgcaagcacgtgacgcggcagctggcacgctacacacgacagctagcaggtgtcaccccgagagctacagccatgctgctgctcctaggnaacagggggcagcacaaacagcccatgtggccagaaaggcaccagtcntccctctcctcgctggtcagtctccaaacagacctcagccagccgcccccaggatggcaccagacaagacaggttctccattcgaaggttcttccaggatgaaaactcctcacaagaccctcagggcacaagtggacagagaacccggcctgaggaacgggatccctccaagcctctggaacccggcctccccaccgctcagacagctgcccctgcccttccaagtcggcaggccagtccctctctaaagacagttcaagggcagtgccacagccacacctgtatattccttgggggaagccgtgtctccattcctgaagaacttgatggtgggatagccgcgcacgccgtactgctgggccaggtcagactcctccgtggcgtccaccttggccaacctgatctcggaaccttctgccttcagcttcccagcggctttggcatactcaggggccagagccttgcagtggccacaccaaggggcatctggaagcggaaatgagatgctagaaagcagccttgatccctaaagcagccttgatccctcagcagtgcttccctttttcctctggcatttcccttcataaaaaccttatctactcaccaagataacccctcctaacgcacaaggctgagctgatagcctggtgttcttgggcaatatcaggacagaggccgntgaacgacaaactaccaccnaaccaacaccagcccccactctgctatgtcaccatcagcacagccagacaaacctttcaatggttgctgacttcttattccccacaggcaactaaggcaaggatctcccctagacntttccctttaagactacagacaaaagtgaagaagtgaccgtggcggcctgtaccagcactagctgtgagtatgagatgcacatccgtgcacacagaccctgagttgcttagggtgagaataagacgatctgtcaatagagttagcagcntgtgtcaggcacaaggttcccaccccagggacagagctcaaatccttatggacgtgaggaaggcttgggattctcctctgagacaccatcggaaggactgctgtggcaagctgaaggtggggtgggcaggagcggggcgccttccgggtcggcccccggggangganctcggcaaggctggacactggcttgctctgtttgctcacacaggtcgatccntgttcttctcgcactaacaggaagatcctgccgtgcgcagggcgggcatcgggacggccccccggnctcccagcccggctctcacccccagggagcccctgacatggcccccaaggcgggcagcaagggagcccttcagttccgggcgcgccgggggtcccgaccccgggggctgccgggccgtgcctgcgtcccaagagcctggctcagcggccccgagccccgcccgcccgccaggcccggcgctcacagaactccaccagcaggtacttgtgggccgccagcgcctccgcgaagttgcttttccgcagcaccaggacgtggtcctcctcctcgggggcgtcggcgcgcaccagggcggccacggccaggcacagcagagcgcggcgcagcatgtcggacacggatcaggcggggcgcttcggttggcgccgccgggacagcgggggcgacgagagcgcgcgccggtcccggcctcgcctttataaatcctgggtccggggcgcgcctgcccccccngcccgcgcgcgctggccgcggcgcgcacgcgccgctggggcccgccttcgattggccggcggacttcgaggctcgtctttgccgctctcggattggacactcacaccaggcctggccccggattcggaaacgctcctgagtgctccctggccttcgttcgggattggccgaggacctcgcgctcgctgtctttcttagcctctcattggctcccgacaagaactttttctgccttggcttctaattggtggctttcgcctgcaccttccacgggtctggaatggctgcccctttcggtagcacggactctgcgcctcctgattggccaagggatgcgcgcactctgcgcgttccttcgtcgaacgtggcagtggggaggagttcccagtttaggggcggagctgcggctgcgcttccgaaacccctcgtgttgcattctgactggaccgcgtacccaactggcacgccccccggcccccggaccggaagttggggtgacgcaatttccggcgcgcgtgtcaagcgtgcggcggcggccgtggaaggtggggttggccgcctagggtcggcggtgggctcggtgtgggatagccggcccggtccgacgcgctccgcgaggtcacgcgagacactcaccgaggcatggcggcagggcctgggcatgggaatcgtgcgcacagtgcgaggaagcctcggaggggatacgagcacagggcgggtggttaggagaatggggctggagagacgggcgggaggggcgggacctgggccccggggacctgccggctcccaggccccaggaagacgctgctcatgcgtggagcggccgcaggaaaggtactccccgctaaggccttcagggagcggccctttgccctgtgcgatctcttccttcctttcccacgggttgccaaatcctgtgacgctgccccttctctggtgcttctcagatgctctggtcggctcaggagacctcgcagctgttacacagctgtggaaataccctgggcgctgcttcactccgaaggcagcagctgggtttgcctcccgactcgacccgccaccgaggctcntgagcacttgaaatatggccagtccacctgagacgggctgtgagtgcgcaatgcacatcaaacttctaagactgagtgtgcggggccgagtgcggtggctcacgcctgtaatcccagcactttggaaggccgaggcgggcggatcacgaggtcaggagttcgagaccagcctgatcaacatggtgaaaccccctcacctcccgtctctactaaaaatacaaaaattaacagggcctggtggcgcgcgcctgtaatcccagctactcgggaggctgaggcaagagaatcgcttgaacccaggaggcagaggttgcagtgagccgagatcgcgccattgcactccagcctgggcaacagagcgagactccatnctcaaaaaaaaaaaaaaaaaagtgtgcgtgtaggggctggaggacagaaggtacagtatttcgttaataactttacattgactactacatgttgaaatattctgtatgcatatgttggattacataataatattgaggccagngtgctgtgtggctcactcctgtaatcccaccacttttggagaccgangcangaggatcccttcagcccaggagttcgagaccagcctgggcaacatagtgagactcccgtctctacaaaaaataaattaaaaaaattagccaggcacggtggtgtgcacctgtggtcccagctacttgggaggtggaggtgggagaatcatttgagcccangaggcngangctgcngtgagccatgatcccaccactgcactccagcntgggcgacagatcgacaccctatctcaaaaaatagtaaaaaantgtccttttttnaaaatttttattttttatttttttgagacagaatctcactttgtcatncaagctggagtgcagtgggcgatctcggctcactccacctcccggattcaagcgattctcctgcctcagcctcccgagtagctgggattacaggcatgcaccaccatgcccagctaatttttgtatttttagtagagacagggttttanccatgttggccaggctggtctcgaactcctgacgtcaggtgatccacccgccttggcctcccaaagcgttgggattataggcgtgagccaccngcaccnnaggncctcctcttctatcttttaacgtggcttttagaaacttttaaaattacatagatggtctgcattttgttagtgttggacactggcagccctccgtctccctcactgcctggaatctgctgctctccttttccccaggtgcctgccctctccattcctcctcactttcctccgctgggaatcggcaccgccactgattttaaagttgaaacttggcaggcaaaagggaggtactcccatgttaaatgtatacacattgactgcnaatagtatcctgacttttgaaatggtaaaacgtagagtaagttgcttttgtactttgagagtttctgttntgttgatcagttgttcctgagaacatgcttctccttccgacagggaactccctccactagaatatgagctccttgtnggtcaagactgggtcccctgttcccttccccccagtgccagcggangcaaaggtcagtcagcggcataagttgtacctgctgggagaactgtctgcttcctccgggtgacttttctggccaagaaggaatatgagtatgtgcctccctgagcactggcctggagcccactcaggaaacaccatctcttcataaatggttttgattgcaggncattgttccttctgctctctggatgatggaaattgcttcaggtcactgcactatcttccaacgtttttgtggttgccatgagctgttgtacagaccacagtttggggcctgagacaagctgggcatggtgttgcatgcctataatctcagctactttggagggtgaggcaggagaatagcttgggcccaggaggtctaggctgcagtgagccatgatcataccactgcacttctgtctgcgtgacagagaccctgtatcttacataaaaccccagcccatatttgtaccacatctagatacgaggtcagagttcagatgcctaaatattgtagcttgtgttttgtccacntgttgggggaagagtgaagagatttgacataccataatgttgattagcttgtgatggtttggcggcagcttaggccagagcataaagtaaaaaggaaaagtgttcacagacaatgaanaactgggaccaagtggtgaatactcaaggcacacagaccaggcaaggatcccagtggccgtggatgagtctcaggctggctctgggccagtggaacacacctcagtgtgggtgaaggcctagccagggtagcagagggcagggctacagaacagcagcccaggtggctgtggccgacctgacattctcctgtgaaaatcaggtgcccaaccagcactaatctagatagatggcagcattttttttctttaaagacaggatcttgctatgttgctcaggctggtcttgaactcctgacctcaaaggatcctcccctcttcagcttcccaaagcactggggttacagatgtgagccagcacgcccagccgaatcancagtatcttagacagatgccatggctgcccatagggtcctctcaaggtgcctctgcccttggactggcttcctacaccaacctgacaggtgcagcaaaggtggactttctggtaaggctggaggaggaagcctggtctgcgatggcctgagacgccctctatgggggttgttgagtggatggaaatgtgcagggcatgggtcctgcccccnagaatgcaggctggttccgctgggncacctgcagagggctgatgtccttttcctgaggcctgctcctgtgccttctaaccctagggtgagaagatgggctgtgttcacctcatgcccaggcccttcgaggagtgtgcccttgggggtcagagccctcctgtggctggtatttctttggatcatcancaggtgctccnagacatcctttagggagtctcaggcttggtgaagggatccattaaatgttgcttagttggtttttgtttgttttttgttttttcgagacagagtctccctctgttgcccaggctggagtgtggtggcgtgatcttggctcactgcaacctccacctcccaggttcaagcgattctcctgcaacctctgcctcccaggttcaagcgattctcctgccttggcctcctgagtagctgggattataagcgtgtaccaccaacccntggatgatttttgtantttttagtagaggcagggtttcanccatgtntgtcaggctggtctcnaactcctgacctcgtgatcctcctgcctcggcctcccaaagtgctgggattacaggcgtgagccatcatgcccagccaactggtttgtgattaaatgttttgattgatgcagtttttgaaatgtactgntgtgtacaatattactcttttgagacagggtctcactctgtcacctaggctggagcacagtggtgcagtcatggcccactgcagcctctgccttgtagccntcaagtgatcctcctgcttcagcctcctgagtagctgggactacagttgtgcaccaccatgcccacctaatttttatttttttaaagatggggtctcctgtgttgcccaggctggttttgaactgctgagctcaagtgatctgcttctggccagctactactcttaaaagtagagttctcagagcaaaacagctccctttcaacncttcagtccggtcgaaggtgtggtgggggtaacaacagcaggctcatggatacctgggcagtgctccgaggtccctcctgtgttcccactgagcagcagcctgctgtgcccggagtggaggtgagaaatccagcagcagcgcggtggtgagtgtgggccctgcggagtgtggcaggcgctcattatggtgcagggcagtgttgggcacagagaaggttctcagaaaccacagtaacccatggttagttnggtcacatcccagaccctgacctagcactggctnggcnactgtgacttgtcactctcctgaatggaagaagtgtccacctgggggtggctgaggaggtggatgctaggggactgctgggagccacggacctgtggaggttgggagaggagactgcaggcgcaggctgctggaggcgaggaggcctctctggagcgccaggccatacaaacaggtcccaggtggggccacgaggatcaggttagacttgggacccgagagacacgtcatgcccactgtgcaggtgccacctcatgttatcctgcaccagggngaggggccagcccaaagtcctggctgctggcagcatgcccgtacagcttggcacctgggtctgagttcacatgtctagcaaagctgggaaaatccaggagcaagaaggtgaagccctttggctcagcccaagctcagaaggcccttgcccgatgagccgaactgctgacaacaccctggcactgggcttggggactcccctggagcatgtaagaagtgaactgggagcgtgggagaaactgtctggcaggggctgctgcctcnggagctcatcctccctggctgtgctggtgtctgtccagtgggattagcctccatcnctgtggtttcaccaccccaccgcctctctcccccacagcacaggcagaagcagcaacgcaacacgagaccacctcgcttggggctagtagcagttctgggaaaggctcggtagggtctttgctccctgcggaatcaagggctgggggctgacccaggctttctctatagctgcttccagatctgggtctggaccagcttctgcaggaaggcaccattctgttggggtgtctgacacggtcagctctaggctcagcctctgcggcccccacaaaggcctagcaaggatggggcaaggtggcagtggtgcccgcacgcactgccctggcacaggtgtgtagttagtgacctgaagcatgagggcatctccctgcccaccccagctggagataagccccttgcggggcccaccctgctgatnaaccccagagcagtatggcctgtgtcagaatgaccagtaggagggccccggggtagcagctgcccagcccagctgcgtgtgtgtgtgaagtattttcctcnaacaccttataccacagaaggcagattttgaaactcgcatcaggccagaaaaagaatttctgaatggacacttctaaggggtgcctggttactcatctgcctcttccccctgcagggtagaggggcatgggtttgaagttcccgggggctcttggagactgcagacacggacgagctggggttcctggatgctgcagcagttggggcccctggctgagcgcacctgccccaggaggccctgcgtggttcccnccagtagccccttcacaccacaccgcagtgaggatgccctgtctcctgccgatcccatcacaccaagcctnttcgctgttgggctcctggcactgcccgatcctggagggcacttggctgcggctgtggctgtgaagggctggtgctctaggcgcctccgtggcccccgttgcctgggcacctacttccntgcntcagccacagctgcatccacgtgcgccaggggccacaaggccgaccctggcttgggcctgttcctccctgggtttccttgggatccagtcattggagggcccgcgcacagctgggccaactcgacacctccaagcccggccagggaatcaagcagctctccctctggcagcatgagctacacaagccaggcccgtcttcccattcccttagcaaggaggggcaaccccagccaaggccttctgcactgttctagactgttgctgcctagggctactgtagctgggagtcacattcctttctccccagatagttgcaaggggcccagcagccacagcanttcaagggggccctgcccttcccctcccaccaccccaccagggtccccatcttcccctttgtctcctaaagcccgtgaggcagtagaggagccaggccctcccctgccacaccctggnagaagccaagcagcagacacccccagctccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctgngctgggtcagggaaggcctgccgggggtggtggcactgagagcctgggggaacaggcgccaggccagtggcccagggacggcacggacggaggcaataaatactgatggccaggcggggctcctggctgggcccaggtggggtgagtgaggctgtccatcgagggctcttgggggggtgtgggctctgggcactgcccgctgagacagaaaaggcagaggcaggacaatacccagcctcctggatggtactgaggtgacttgagttttggcaatttggctttccccaagccgccgngagccatctccacagccctgtccagggaagggggcaggctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcggggctggaggacggcccggcccccacgaggccgtgcatcccacaccccagctccaccccggagcagcagacgcacacgtccaggggcaaccacggggcctggagaatggctgctccgctccctcctgaagccagncntcgggtgtgacggggagatagaacntggggggcacagaaagggcagcagaggcctggctgcggcctctctcccccacagcacaggcagaagcagcaacgagacaggagaccgaggaggctgggcctgtgggtgggggagggctgaggaggggggtcggaggcanctcggttgagccaggccagggaggcggaccagggtgggaggggcacggagggcctgtcagcactttggtatggggaggggaggggctgggggggnacacatnccngccnngtccgtcgtccgtccgtcagtctgccctgcccgcctctggctgggctcagtccttccagtccttcttgatggtgagattccactcccaggacaggtggtcggtctngtcgtcgtctgtgaagcgggacttgatgctgtagctgccccgggccagcatacccttgggtgcctcctccacgggggtcaggaactcgtactcctcggcccggggcccatagctgcctaccatgtagtcagtcttgtcaactgcggcacaanggaagagggcggtcagcggccccgcttccccgccntggcagcacgcacccaagcggccccctctgccctgcccggggccccactcactcttgacgcctttcctgtacgtatgctggatgtacttcatgccggacactatctctcggttaacctgcaggacccgaagcgaggatcagggaaggtcggtccggaccccagccccagccccgcctccattccctggccacagcagcctgtagcttacccggaaagagatttttatccggtactccacaccctccttcagcacaaacgactgcttcttgaagctctccaggtcgcctgttggggggacctccccctcaatgactgcccagcagccctgcgcgaagccccagccctgcgcggccccctggctgcacttcccgagatccccaccaggggccgncccggacccccgcggccgcagggncactcacccgtcaggtccagctccagggggcccggggccgagctgcacaccagggtcaggccagtcaccnacgacgttggggacgttggggtctggggagtgacagcaggtgagggccccacccccnaccagtggaagtaggggctggggagcggcaagacagctggagtgaacgggcggccacccggctcccgcagcccagactcacctgcggaaancggccacgcggcccagcagggcctccttgtactttcgcaggctctcgtcgtccttgtccagctcctggatctcctggatgctcttctgggccgggggcttgtagttngaccgagtgctcatcctccnntcgttctccgctgcaatctgggccagctgctcggctgtgggctcctgctcagccatgctcaagcttagcctgggtcgggacacctgtgggcgggacggtgacaggccttggacctggatccccaacggaggcgcacttctgagcaggagtgtgggctgcagccggagctccaaaagggctccaagggggccaccttcgctcctctccacccccgcgattcctgctcaggggcatcctctggggcagtgtgaggtgcccccaccccaggtatnaacatctaagacaaaatgggaactgcagccgatcatggggagagaggacacacctccccctccacgatggaggaggcagcagccccctgtatgtgtggggcggggctagcaggccccagaatcaaccggcggggcccacactaaaccctctcttagggtcttgccgctcttgagctgcccaggccctcgccctacggggtaacggggctcggtatccctcagtagggttgctcctctggccgtggtagtcacatgtaaacgtgtgtggtcggctcagcgtcatctttcaaacaggatgcccctggagctcggatgttaggggcagctagaataccgcacggggccacctggacacggggatcctaagtatctgcggtttctccacaattgtgaggntctgtgacctacaacttgggagctaccacagccactcagtactctcgggcccntctngtagatggtgggcccngagtgcccggggcagcactgacccggcaggggatctgtcaggctcagatccttcccggcagcgtgggaggtgggtcagggagcagcacacccgggacacccaggccggggtccaggccgccctgcttcctccaggggctggggcctccgcgccgcgcgaggatagccgtaggcgccgggatcctagggcgcggcccncacttccgcaggncccgcaatccgtgccgggcgtgncccgggcgctgggggaggccgngccccaatcnccgcgtcgcccccgaacgcgatggaccgcggctgccggcccggcgccncccgcgtccccaaggaggggccctcaggtctggcccgggccccacgngcctcggcggccatgaaagaagctccggaccgctcgggaggggccggcactcccctggtccccgccgcccctccggcccgggacccgcangtggggccggggccgccgccgcccggtcccgccccggccccgccctagcccgcaccgccctggcccgctgtcaccgcgcccccgcccgccgagaccctgccgcgggctcagggcggggcgcgaacaaaggcggaagcccccacctcagcgccccccgcnncnnnngnngnngccngncnnnnnnccnnnnnncnnnnncnncnnnncngncnnnncnncncnacnncnnnnnannngnngnnnnngccnngcnnnnnnnnnnnnnnnnnnnnctnnnnnnnnannnncgnngnnngcnnnnnnnnnnnnnnntnnnnnnnnnnnnnncacnnnncntcnnntnnnncnngnnggnnnnnnnnnnnngnnnnnncnncnngngnnnngncnngnnnnnnnngnnnccnnnnngnnnnnnnnnnncntnnnnnnnnnnnnnnnggnnnnnnnnnncntnannnnnnncncnnnnnnncgnnnnnnnnnnnnnnnnnangnnnnnncnnnnnnctnnnnnnnncnnnnnnnnnnnnnnnnnngnnnngngnnncnnnnccnnnnnnnnncnnnnnccnnnnngnnnnnacnnnangncnnnngnnnncnnnnnngnnnnggangcccgngnngnngnnnnnnnnnnncnnccnnnnnncagtcggtccgactgcgactcttgcttcggggcctagtcacctagtcccgnganttcggggaggtaacgggcacggggattaagttctngttaaacacgggcgagagcgntggcgcgcggnccgttccagggccttggtgtcccccgtggaaagacagggctgtggggctaggaggagccccttgcacgccccgcggaaagcngntgctgggcgagggcgcagcggaggtgtttttctccaggctgagacagaannnnnnnnnnnnnngngnngnnnnnnggngcaggcgccgntgcagaggccctagtgtccntgaggaatcccgcggctcctcaggaccaggaggcagggagctcctggcaccgtgagcagatgaggggctgcctcagcctgggcttcaccgcagagccntgttccccactccgcttgttcngagattccacacattcgcccacaagggccgtgttgaagtatcaggaacggccgcataacgtgagtggcctggcccagcagcagtgctngcacccagccccgggctcgcctntcctggaggccaagcccntaaatgccntgcaccagacactgggtgggacgctgccccgcgtccagcctgcagcacttgttaggactgtggactcgttaacgtggacgcctcttttatttatnganttgattatttttttgagacgtagtctcagtgtcgncccaggcttgagtacnatggcacaatctcggntcactgcaacctccacctttcaggttcaagcgattctcctgcctcagcctcccgagtagttaggattacaagtgtgagccaacatgcccagctaatttttgtatttttagtagcgacagggtttcaccatgntggccaangctggtctcgaattcctgacctcaggtgatccacccncctcagcctcccaaagcgctgggattacaggcatgaaccaccggggtgcccaatctttttttttttttttttttttcttcaagacagggntcttgcntcttttgcccaggnctggagtgcagtggtacaatctcagcttactgctgcctctatctcctgggctcaagcagtccttccacctcagcctcccgagtagctgggacntacaggtgtgcaacaccatgtccagctaattttttattttttgtacagacagggtctcactatgttgctcaggctggtcttgaacccctgagctcaagcgatcctcctgcctcagcctcccaaagtgctaggattacaggtgtgagccaccatgtccggccacccagcctcttttaatcactcttgagctccatgcagacagggccctgtctgtttggcccatactgccaggcaacccaggctgatcaagagaagtggagaccacacgcacacacacacgcacagctgctttgttcagacacagacatgaacacaggagggcatttttggggacagaactatgcaaaataccgagcttggtgtcttttgaaaatttctgaatgttggagggatatttgagagtttctgtaactgagtcacactgtcagtgccatgtcatcagcacangcgtttcctaatcaggtgtgaaatgcttcanctgttaaagactcagagcccctgtgcaggtgatcatgttgcccaactttccaataacccaagtgcttttaaaaaaaaactgttgggccgggcgcnggtggctcacgcctgtaatcccnagcactttgggaggccgaggcgggcggatcacgaagtcaggagatcgagattgtcctggctaacacggtgaaaccccgtctctactaaaaatacaaaaaattagccaggcgtggttgcaggtgcgtgtagtcccagctactcgggagggtgaggcanggagaatggcgtgaacccgggaggcggaacttgcagtgagtggagatctcgccactgcactccagccggggcgacagagcgagactctgtcaaaataaataaataaatacataaataaaagattcgattgtgtgggtatacattttgtttgtaaccattccagttggcaaatatttggtttcttttttgtccattatgaataatactgccataaacatttacgaatattataaaccattataaatgttgcattaagccttttcatgaatatgtgctttcatttctcttgggtagattcctgagtggaagtccccaaatgttttccaatgtaggtgtgccactttgcaccccctagcaacgctgggctgctccaggtggccacaggctcagncaatacctgctgtgcttgatcccagctgtacaagtgtgaagcagtgtcgtgtcacactgtgagtcgcacctgcacttccccaatgagtcttcctgggcagaaaccntatttaaatcttttgctcatttttaattgggctgtctgattaagctatgagtacttacatatcctgtatacagtcctttatcagatatatganggctgggnntgcagtggctcacgcctgtaantcccagcactttgggaggccganggcaggcggatcacctgaggccaagagtttgagaccagcctggccagcatagcanaaaaactgtctctaccaaaaatacaaaaattagccgggtgtggtggtgcacgcctgtagtcccagctattcgggaggctgaagcaacacaatcgcttgatcccagaaagcagaggctgcagtgagctgagattgccccattgcactccagcctgggcaacaagagcaaaactctgtctccaaaagaaaaagataggtgatttgcagacattttatgtggtttgtctttcattttcttaatgatgtcttcttaagggcaaaaccttttattctagtgcagtagttttttccacatggtgcatgcctttgctatcctaagaactcctngagctgaggtagngcggatcacttgagcccgtgatgtcgaggctgcagtcagctatgattgtaccactgcactccagcctgggtgacagagaccctgtctcaaaaacaaactcttagcccaaccggatattgtaaagattctctctcatattttttctgtgatcttctgctatattttatgtttgctgacatttagatatacagtccgtatttgggttaactttntcgtatggagtgaacatcttttctgtgtgtaggaacatccacctgtcctggcaccccttgttgagaaactatcgtttccccnaatgcaatgtctcaccacctttgttgaaaatttnttcaccataggccgggtgcagtggctcacgcctgtaatcccagcactttgggaggccaaggcaggcgcaacacctgaggtcaggagtttgagaccagcctgcccaatgtggtggaaccccgtctctactaaaaatacaaaaattagccgggcgtggtggcacatgcctgtagtcccagctactcgtgaggctgaggtgggagaatggtgtgaacccgtgaggcagangtttgcagtgagccaagatcgtgccattgcactcncagncctgggcaacnagagcaaaattccatctcaaaaaaaaaatttttgttcatgtaaatcgaangggtttattacaaaaattagctgggcatggtggcgcacacnngtagtcccagctactctggaggctgaggtgggaggatcacctgagcctgggaggtcaaggntgcagtgagctgtgatcatgccantgcactccagccttggtgacaaanggagatcctgttgctgggcatggtggctcatgcctgtaatcccagcacttngggaggccgaggtgggtggatcacctgaggtcaggngttcaagaccaacctggccaacatggtgaaacgtggtctccactaaaaaatataaaactagccaggcatggtggcacatgcgtgtaatcctagctacttaggaggctgaggcaggagaattgcttgaaaccgggaggcagaagttgcagtgagccgtgatagcgccattgcactccaacctaggtgacaagagcaaaactctgtctccaaaaaaaaaaaaccaaaaaaaggccaagtgcggtggctcacncctgtaatcccagcactttgggaggctgangcagatggatcacctgaggtcaggagtncaagaccancctggccaacatggtaaaaaccccatctctactaaaaatacaaaattagccgggcctggtggtaggtgcctgtaatcccangtactcgggaggctaangcagaattattgcttgnacctgggaggcagatgctgcagtgagttgagatggcaccattgcgctctagcctgggcagcagagagaccctgtctctcaaaaaaanaaaaaanaaaaaaaaanggncanaaaaagacagacagacatatatgtctttnncaatgctacgtcctaaaatgatggcatcacattaactggctttcttgcattactaaaaggatgaacttttaaaataattttgttatttaaaaaccttgtttatttttatttgttgagatggagtcctgctctgttcccgaggctggagtgcagtggtgcgatcttggctcaccacaacctccacctcccaggttgaagcaattttcctgcctcagcctcccgagtagctgggactacaggcacgcaccaccatgcccagctagtttttgtatttttagtagaggcggggtttcaccatgttggccaggctggtcttgaactcccgacgtcgtaatcctcctgcctcagcctaccaaagtgctgggattacagatgtgagccaccgtacccggccagaaacaactgttttttaatttttcttttgagacggagtctggctctgttgcccagactggagtgcaatagtgcgatctcggctcaccgcaacctccgcctcccaggttcaagcgattctctcctgcctgagcctcctgaggagcttgggactacaggcacacgccaccacgcccagctaatttttgtattcttagtagagacggggtttcaccatttaggccaggatggttttgatctcttgaccttgtgatcgcctcagcctcccaaagtgctgggattacaggcgtgagcccctacacccggccgaaacaactttttaagatagaatctatgttgttcaggctggattcaagttcctgggctcaagtgatcctcctacctcagcctcccaagcagctgggactataggcatgtaccacttcgtccagcttcncggctttttccatggttgtaaactgcctattcatgttcttggtggtaaatgtttcccaaggttgtttgtcttgaatttgtgagattgtctgatttgcagaagtttttgtttgagagtcttgctctgtcacccaggcagtacagtggcacgatcttggctcagtgcatcctccacctntggagctcaagggatcctcccacctcatcctcccgagtagttgggaccacaggtggcaccatcatgcccagttaatttttttctttttatgttacagcaatgagtctgggtactttttgcattttttaaatgttttttgtagagatgggttttgccatgttgcccaggttggtgacttacagaagnttttttttttttntntttttttttttttttttngagacggagtctcgctgtcgcccaggctggagggcagtggccggatctcagctcactgcaagctctgcctcctcggtttacaccattctcctgcctcagcctcccgagtagctgggactacaggtacccaccaccacacctagctaattttttgtatttttagtagagacggggtttcaccgtgttagccaggatgatctcgatctcctgaccttatgatctgcccgcctcggcctcccaaangtgccgggattactggcatgagccaccgcgccncggcctacagttttaaaaagtccttactgtcctgcaaagatagggactcttttacctaacaataccatgaacacacccaccaaaactgacaatgctttctgacatctaatagtctctgctcaattttccccaagtctcttcttgcaattgtgtccccacatcagaatctggacagaggccgtgctgtgcactgggatgcccactgcctctatttcctcttctgcgcttggtgccacccaggcgtccaggagccagtgtgttttgctgacaatgtcctgtgttctggatttgctgggctgaaccctccaggtgtcctgtgaaccctctcccatcctctgcacttcttaggcaggatgagcccagttcgagttttagaggcggtgctgggggcctcctgctgcttcacgtcattggacttgtcttctggtcctacctgtagtgaggtatggttggttctgggaagctgggctggtccacccattatcagtggcctcctcaactgtcatcttcaattttcactgtttctcacatgcatcattttattggacacttcaaagtggtgattttctaattttgggtgtgttttttttttttttttttgagagagtcttgctcttttgcccaggctggagtgcagtggcgcactctcggctcactgcaaccntccaccntcctngagttcaagtgattctcatgcctcggcctcccaaangtgctggagttacaggcatgagccaccgtgcctggcctgattttctaattatttctgtatttcttagctggaattatttcttttttttttaaaggacccncgtcatcaattgttgccccaaaattatagagttcatacagaaaagacaaattaaatgcccgattctttccttttatttgccaatttttatgagtcagtgccttacaacttccaaaggtaaacatgaggcttctttccttaagcatcatcatgaactcttagatgttcatttattcaacacaaactaaaaaaggaatgttaagtcttaagatatcattaatactaacttgcattacttgtttatgaaggattaatatactaaatagaatatatgctcacatttttatatgtagatattaatttacaagtaattaacatgctaaaacattttataattcgcttcaataacgtgtatagataacnacaaaaattaactctggcctaccttaggctacatgatcacagacaagctgatgtaattaaaatgagaagatttatttcttggtactttcatggctttatttttacattaaagtcttttatgatgtattatttattgctatcttccaccaaatgcttggccagtcaatcccagggtgatcttaataataacaactaatacatgtaaaccataaacatttatgaaaattatatatcctcatataaatttcataacatatgtaagttacaaaagaaagaaaaagtcaacgaggatatgggggaagccaaaaggaatacaaactaacaaatgaacctaactatgtacaaattatgcaaatcacataatttgcaggaggtggaaagaaagaaaagaactcatctaggcaacttttgaaaccagtacttagatgctacaggtcaaacacaaaaacaacagtacacgattaaggaagtaaggtgcctccatagtgactgcgcctccctggggcacaggttgaacagttcacctacagcactgacatggcctaagcgaatgtcctgtcaatctgagagccaggtttctccctgtcacaggaagaaactacacataagngaaaggggcaggtgagacaggaacagcaggaactagacagctacagaaaccaacagggcgggtaaatgcacaagcacgtgtcatagatccacttcccagctctgtcccaggagggcccagaagcaacaagcacagccagtgcccaggtcttggttgctaaatcccagtctccagtgagggagggctccctggagaagcagctgggtgcagagctgggacaaggaaaactgaagacatcccaaaataaacaagtgcttaaataaggatagggcacaggagacaatctccaggagctcccaatggccaaagcgtggaaacagtatcagattatgactcacagaatccaacaaacagcccttgcgttcatactgatatataaagaaagaaatcgtaggtcaggcgcagtggctcatgccttttgggaggccaaggcgggcggatcacttgagctcgaaaatttgagaccagcctgagcaacatgggtaaaccccatctctacaaaaaatacaaaaagtcagctgggcatggtggtgagcacctgtggttctggttactcaggaggctgagatgggagatcacgtgagcccgggnaggtcgaggctgcagtgagccgtgatcgagccactgcactgcagcctgagccgcagagcaagaccctgtctcaaaaaaaaaaaagggaaaaaagctgaagggactgctctttcttagagatgaattccaattaataaacgtcaaaggaatgaggaaaatgcaaaaatcacctttgaaaactaagttaataattactgcattgcaagacccaccagtggatgctgaaattaattagtgggtaggccgggcacggtggctcacgcctgtaatcctagcacctngggaggctgaggcaggtggactgcctgagctcaggagttgnagaccagcctgggcaacacggtgaaaccccgtctctactaaaaataaaaaaaattacctgggcatggtggcgcgtgcctgtaatcccagctacttgggaggctgagacgggggaattgcttgaacctgggaggcggaggttgcagtgagctgagatggcgccattgcactacagcctcggcaaaagtgagactccatctcaaaaaaaaaaaaaaaagtgggtaaaacttggaagtgaaacagacattcacttagtctggaagtatctccccaaggtatttatggatgacaaagggaaaacagtaactatgtaggggagaagccccggcagccgctgncaccacctgaactaacaggaccaggagttggacagactgacattgcatatctccactatgcattgagaagatgacatcccagctgtggtattcatgccaaaaaataaaataaaccagcagggcgtggtggctcaggcctgtaatcccagcacttttgggaggccaaggcggatggatcatgaggtcaggagttcaagaccagcctggccagcatggtgaaaccttgtctctaataaaaatacaataattagccgggtgtggtggcgggtgcctaaaatcccagctactcaggaggctgaggaaggagaatcgcttgaacctgggaggcagagattgcagtgagctgagatcacaccaccgcactccagcttagaagacagagaaagactccgtctcaaaaaaaaaaaaaaaaacnaaaaacaaaaccttgtccagtcataaggtcagagtccccagtgtgagggacattctacaaaatagctgagagtaccctttaaaagtgtcaaggtcataaaagacaaaagcttcnannaatcnnaatnnannnanannncttcnnaaaattcataaatagagaaataggctgacattaataggctatgttcggtgtggtggctcaggcctgtaattccaacactttgggagaccaaggcaggaggatccctggagcacaagagttcaagaccaacctgggcaacatagtgagaccccatctatacaaagttttaaaaatcagccaggcgcggtggtgggtgtctgtagtcccagctactaaggaggctgaggtgggagatcccttgatcccgggagttccaggatgcagtgagctgtgtttgcgccactgcactctagcctggacatcagagggagaccttgtctcaaaacacaatttttcaaaaatttangttttttaaaaaagatattgagatgctacaatgtccatttcaggaagaatatcatagcacttttgagacaagtttctttttttttttgagacacagtctcgctctgtcacccaggctggagtgcagtggtgcaatctnggctcactgcangctncgcctcctgggttcacgccattctcctgcctcagcctccccagtagctgggactacaggggcccgccaccacgcctggctaattttttgtatttatagtagagacggggtttcaccatgttagccaggatggtctcgatctcctgactttgtgatctgcctgcctcagcctctcaatgtgccgggattacaggcntgagccactgcgcccagcctgagacaagtttttctacaaaatgtaatgacattaaggtaatatgaagagacatgatcctcatctttatgtaactggagttcaggtattcattacgctcaacaatatcaaccttttatgatgctattttgttgaatgtgatgaatgccactgataataggacatttaattccatttagaatatctgtatttccaagtaaagtcctaaatctgccagggtggagatttatccatggtaaagtctattcaatccagatataaaaaagatagagattgagggccaggcgcggtggctcacacctgtaatcccagcactttgggaggccgaggtgggcggatcacaaggtcaggagatcaagaccagcnctggccaacatggtgagaccctgtctctactaaaaatacaaaaattagctgggcatggcggcacgtgcctgtaatcccagccacttgggaggctgaagcagaagaattgcttgaacggggacccgggaggcagaggctgttgtgagctgagattgcaccactgcantccagcctgggctacagagcgagantctgtctcaaaaaaaaaaaaaaaaaaaaaaaaaaagagagattaaagacatttaaaaaaaagattacaaagaagaaactgcaaagcaaaatcacaatgagatattacttcacacccagtaggatgactaaactaaaaaaggtaagtgttggtgagaatgtggagaaattggaaccctcatacattgctggtagaaatataaaatgctgcagctgctttggaaangtctggcagttcctcaaaaaattaaacagttacctcatgacccggcaattctactcgagaattgaaaagatgttaatataaaatgtatacaaaaatgttcacagcagcattattcttataaagccacggnagtggagacaacccaaatgtccatgaacagatggacaaaaaaaaaatatgcggtatatccatgtcagtagtcggccataaaaaggaacagtcttagacatggtacagcacagatgcaccttaaaaatgctggctggggacaggcgcagtggctcacacctgtaatcccagcactttgggaggctgaggcgggcagatcacgaggtcaggagatagagaccatcctggctaacaaggtggaaccccatctctactaaaaatacaaaaaactagnctgggcatggtggctgctgcctgtagtcccagctactcaggaggctgaggcaggagattggcaagaacccaggaggcggagcttgcagtgagccgagatcgcgccactgcactccatcctgggcaacagagcaagactctgcttcaaaaaaaaaaaaaaaaagaaaaagaaaaaaaaaataaccgggcaaggtggcaggtacctgtaatcccagctacttgggagactgaggcaggagaattgcttgaacccaggaggcggaggttgcagtgagccgagattgcgccatggcactccagcccaagtgacaagagtgaaactccatctcaaaaaaaaaaaaaaaagaaaataaaaaaacttgctgggcgtggtggcatgtgcctgtggtcccagctacttgggaggctgaggtgggaagattgcttgagcccaggagtttgcatttacagtaagctatgattgagctaccacactccagcctagagagcaagaccctgtctcttgaaaaaagaaacccggtcgggcgcggtggctcacgcctgtattcccagcactttgggaggccgaggggggcggatcacgaggtcaggagatcgagaccatcctggtgaccacggtgaaaccccgtctctactaaaaatacaaaaaattaagccgggcgtggtggcgggcgcctgtagtcccagctactcgggaggctgaggcaggagaatggcgtgaacctgnggaggcggagcttgcagtgagtggagattgcgccactgcactccagcctgtgtgacagaggaagactccgtctcaaaaaaacaaaaacaaaaaaaaccataggctgggcgcagtggctcatgcctgtaatcccagcactttgggaggcccagctgggcggatcatgaggtcaggagatcgagaccatcctggctaaccncggtgaaaccnccatctctactaaaaatacgaaaaactagctgggcatggtggcgggtgcctgtagtcccagctactcaggaggctgaggcaggagaatcgattcaacccgggaggcggaggttgcagtgaggtgaaatcatgccaccacacacgtctgggaaacaggaacgaaactccatctcaaaagaaaaaaacaaaaaacgaaaaaacaacctctaaaatgaaagactgtatccctagattgctgagaggtaaatgaaatgtatgtagaacatccagcagnaggtgcagcctcagacactggctgaccatttgtgcaacctgagagaggcgtgctcttgcagcttgagttccaaccatgccccacactccactcccnattaggctacactgcaacctatcacttgtatgtttcctatattagaccatcagttcactgcatgttaagaaccaaaagttaccatttacatgacaactctgnttgccaggtacagacatagccatctcatgagatctaaaaggatgtctgagagcaacactgtagccctttaacccacgtgaggctgaacaggattcaatcagctgcccagtgtagactgctccttagatctccgtgcacaccagccagaaaccagagcactgtgggagcgtgtgcacgctcacatccgagaccctctccagggacctcaggctgaagacggagctgggcagaccatgagccaccctggaagagctccaagtcccacaggaatgctgcctctcctgcccggggctggccagttcctactctcagcccatgccggccagggaaagggaccaggaagaacagggcttcccttttctccccaccctgagtgtaatttcgcttgtcgacacttaagtcatgtgtccaacctgggccaatccctgtgctttctttttttgccccgagatggagttgtgctctttttcacccangctggagtgcgatggcgcgatctcggctcactgcaacctccacctcctgggttcaagcgattctcctgcctcagcctccggagtagctgggattacaggtgcatggcaccatggaaccacaggacagccagaggcagagggggttccccanagtgcccatggggcacaggctgccagttcagtttgtcagccatagctcgctgtctgagcaaagcatcactcagtcaccatgtggggggcagcagggcactgggcagtgtggagtgtccgccctgcaaggccctgtgcccggaggactggcagcancccttcnagaggggaccagacagcccagctggccnaggcctcatgtctacttgctgtctgtgcagtcagtggaagagccctgctcttctttctctcacaagcaccctgctggaacaataaattaaatagtcctctggccttggaagtaaaataaggttttgtgttttatgaataaggaaatgaagattgggtatgatgaggctcagcccagctacctgacctgctgcccaccagaagccccgngtggcttccagacccagcctctatcctagttataaatggccagccccacctccaccacaggcacagaatcaggtcattctcctttgaccactcggcagcacctgcctcaatgaccccaccactggccccccagcaaataccagctgttgcttctatgacatcattctctctacttcctttacctccaaccctcccaagaccatgccacatatggacacgacttcgacgtgtccacgtgctatcagctgacaaactggagaggtccggctctaggcaacgctctcctgcgggccagctggtgcctctgcccagcctgtccaatgctgacgcccctcagctggctccttcctggggccttctctccagtgacacctacccacccagttccccaaggcctcatattacttcattcccatgcccctcactcccgagaatgccaggaagtcccaaatcctggtcattcctccctccaaatgcctgttacaccactactgcacaaccaaagcaatgctgcttgtcagtcctgtcatttgtcacaccctgcaggggctgaccacaccagtccatcaggtgccctctccacttcctaagcagcagggagccagtcctagcacggccccagagagcagaccccctgcctggcatgggcctgctcaggccttgctccaacaccgaggcccgggccaagggcacctgcttggggataacctgactctaactcactgcactggtgacattttctgtcacattcacagcgactacagctggggacttagtaatcctttctcctgctagactgggcttctggaagggccaagattagtcatcctgttcatctgggttcctagactgtggccctggctggcattgggcaagctgcttagatggcagctgctgatctgtagtgacatctgtgaccgacagcgaaagaaccaccncttagtcacactcccttgcccatgactcagccaggcccatcccagcgtggaagcaagcttagcctgggatgtgtgcccgcaggagccgctggtgcagggaaaggtttctgcagacacggcatgcattcctgtctgtctctccnactaccactgcccactgccctgggcttccttacatcccagctgtgggacagtggggtcaggcagaactctggagctcccttgtcccccttcccatctcattctcaaagtgctgtcaccaacccagcatcagggggcacaaggctctctctccactgcccagcttggagtgcagtggcatgataatggctcacagcagcctcaacctccagggctcaagcgatcctcccacctcagcnctttagaatagctgagaccacaggagcacgccaccacactcagctaacttttgtatttttagtagagatagggttttgccatgttgcctaggctggtctcgaacttctgggctcaagagatccttctgccctgacctcccaaagtgctgggattacaggtatcaggcgttgccctactcctttttgagacggagttcactcttgttgtccagactggagtgcaatggcacaatctcggctcactgcaacctccacctccctggttcaggcgattctccagcctcagcctcccaagtagctgggattacaggcatgcaccaccacacccagctaattttgtatttttagtagagacggggtttcgccatgtngnccaggctggtcttgaactcctgacctcaggtgatctgcctgccccagcctcccaaagtgctgggattacaggcgtgagccaccngcgcccnagcncgccccactcttaaatggacggattatcacagcttccaccagccacttcatcaaatatacaactaagagaggatcctncatgccttgctccgnggcaaggttaaaaacaacaacaaaaaaacaaacagaaaaaggaattacactacaaagtcaaaactgctgaatccacgtttctctgaaaaccagagtacaagaaggaaaggaacagcccagagatgttctggctgtgggaagcctgtggacggcacacagggcagccatcccaccnccaacctcccctcacctggaggcacaggcacaagggtcaacaggtggctcccgggcaaaggtgtcctcccacctggtgagttagagaggaaggtgttaggtgtgaggcaggaaagaagataagaaagaagacaggcagcttcggccctccaggagcggggaccccccgccacnccccacaacccatgccaacttcaggtgtccaacaccagatggggctgctccctccatccccaactcaggttctcccaccccctcccagctggacagacaccaaaatcctggcccaggcctggactccaacagtgggacgaatcaaacagttccagttctacacacatttctattttattatggaaaaggtggaaacgccacncttctccacaacagcaaccagtaaaatttatcccaaaaataactcggtacaaaacaggtctgtttcagaattaaaaaaaaaaaaaaagaaaaaaaaaaaacctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccatctgaancacagaggagaaagaggcttgcattcacaggcggcctgctccccactgcggctttgaccaggcccccagctggctcccccgggactcactctcgcattataggcgtccagctgggcatccagctcctctgccgaaagctgctgctttgaattncctgccggcacctctgcctcttccacgggcgcctccgcgggtgcctctccgggtgcctccaccaccaccaaaacctccagcgccacggtttctagtcatgccacctctgtttacgctagcaaggaagacgaaaccgttcacacacccggaaggaccctaagagcgacgcagcctcacccntcggccaatccccttccccagaggccccggaagtcacctctgtgcaggcctccgctgtgcgtcaatctgtgacgtgacaagctgaatgttcatggggcggcctgcggcaaagaatacgagaaggcacgttctattgagaggnctctgaaacccacccagctggcgccacaccctggtctccatgcaaacactggaaagggcctctgtgcgtctcaaatgcccccgacaagggaaatggcctggagatactggtgggagaacaaaatggcaaggaagcaaccccaccaacacctcctcactccttctcagtccagactaggtgggctgctcgctgaggtatcggggtgctcgtgggtggaganggtgtgggtgacctgacgaagaagaaccggtacctttgtctttacgactacagccccgcactcagaggtgtactatggcggttctgagaaggcttcacagaagtgaatcttccggaaggagctgaaggaggggagggatgtagcttgctggatgggggttcacanagaggttggtccagatgtgtggggcagcatgagaggtggcagatggaagagagagacaaaggggcaaatgcaaagtgtcctcagccacaggggtaccccatattcctacctggacaggtgccagccccaaactccacanagccccacagtcagcgtgggtccacccccagactcaccatccagagggacgccgttgtactgcttcatggncttcagggcatctgccttccgctcaaagtgcacgtctgctgttcctaagctgcgaccagagcgatcatagtgcacagccgccttcttcagcgttccaaattcagcaaagagttcctgggagttgcagagagcagttgtcagaaaagcaacaaaactgcgttccttctggtggcccagggacaggccctggaagcgtgagttgctttgggggtggttctctgggaggcaggacagtggttaacgggaaatgagggaagggcggggcaggagggacagcaacttccaagagcacctgggtctgagggctcctgccattgtggggacctgacacgtgtaccacgatgcaggtagaggaagctgcaaagcccactagcaacgggcacaaaattaagccactatcctcttcaacaaaggaaaatgtacaacacanccncaagggctgttccaagaaacggtaaaggccaaaatcaagagcaagggaagcagtccgatatcagaccagcttgaagggcctgtagattcgggagccctgaccccagcccctcccccaaaggcagattctggctcacctttccctctcctcctactcaagcctgcggcaaagtctgaagtcaagcgctgtcatggaaactgccctgacctcaggcaggctgggagttggagagggaacccagagtgtggggatactccggccngcaggcacacagcgggaactggagttcaccaaaagcggtttccagtnggatgctagaaaccaccttaaaaaanagtgttgagacactgtgagtgctcactggccctactctgtcctcccaaggcaaatggctgggctgtgggcaactgaaccctgcccnagccatctccaaaactgattcccaaaaagtcatttcttaaccagaaaacaagttgaaatgccattgggattcaatttttctttttttaaaaaagaaaagcttcaaccaaagatggatttgagagtcatgtcactgacgggacacggcggtggggagtgataaaaccacangcgtacaaggntctttataagacagtactcaaggcaaacagagccagaaaaacagactccctgtgcttcacaagatacataaagaagattctttttctcacattaacccactaagacaggcacaaaatttaaaaagcaactgggctgggtctaacagccaaaaaccactcacatttggtcagtctttgtccctgnttagaaactggaagccctggcaggggattttcactcacagaacccatcnttcagactaacagcagcagttcctcaggctcagctaggctcgcacctgcctgcgcactgaccccggctttactagcactgggtctgtcctgcagcccttcagagctgggagggctcccttcgctaaggcgggaaggggactcagggccacatccccaaaatcacgatccgtcctgtgcagggcgaacggctcaccgagaagccctcgtctcttacctgaatatcggcgtctgagactccaaaatccagattggacaccagcagtttcccacctgtctccacgccggcaccaccgccgaagccactgtcgaaaagatcgtgctgccacttgtcgggaagttgttttnggctgaaaaaaaaaccgcaacaagagcagatctgtgagtctcagtccagggctttcctgaccctcacggctactccggacccttcctcttcccggcctgagaggatccggccgaaacggggccgccagcgctccctccggcgctgcagctgccccagcccgaggccgcacggtcccaccgcggccgcacaacttcagttcccttagactaacttcccgccgcctgtgccgcgcccagcgtcccctcctctcctgccacgaggccccaacgtccggaacaaacaaagagctgggaagggtctcagcctccgggaccggaccccgaaagaacgacctcgctccngnccacnaccccctccgcgcccacacgcaccctccggacctccgggcggccgctccaccagccttatccacccgccggcccgggtctccgccgcgagcggccccggccccagccccggctggccccctcccactctccggngnggncggcctccgcactcacccngntgnagggcgccggtcggttcctnccgnctccgccggcnncgccncgggcgatggccggncggtnncngatgnnccngncnnctcgattcantngcncgnnggcntgcgccccaccnnngnggccncnctggnanccgnncngncnnnnnnnncnncnnnnncnncnnnnnnnnnnnnnnnnnnnnnnnnnnnnnnnnnngtcgtccagagacangtccattnngtcnnccatgncgggcgcgnantcnggcatcggctcgagcccgcgnntcagcacgccngcacgtcacntcnggcgcngcgtgaggcctnccggtgccacggcctcggagcggctgctgattggccgctggcggacggctgcgcncgcgggacggggtgaggcggggaggcgcgtgcncactggcgtgcgagactcggcgggcgctgttgagggagtcgggccgcgactgtggtcgtttttataccttcccgcgcggacgccggcgctgccaacggaagggcgggtagggcggtgcgtgattaggttggcgaaggtgcgagggcgcagggggtggggcggcggccgttggaggcggagcctacgcgcccctccctccccgcacgctccgcccgatcggccagggctgggggcgctgggggcgctacgggcgcggcgggtgcctgggagctgctgggagtccttgtttccgctcccgcccaggactgtgcgctcggctcgcggtggggtccggcgggcgcggcttcggcgggcggcagccgctgcagacgagctgcgggttggttttttggtctccacctgcagcccccccaagtctgcactgtcacattttgccagtcatatcctttacaagttttcttgcgggccgggcgcgggcctcacgncctgtantcccagcactttgggaggccgaggcnagaggttcgcttcagcccaggagtttgagaccagccggggnnacatcgtgagaccncnatctctaaaaaaaaanntgagctgggcatgntggtgcnctnctgnactancagctanntnnnngnccnagnngngnnnnntgcttgagcccaggaggtcgaggctgcagtgagnccgtggtggcaccactgcactccagcctgggcgacagagccagaccctgtctccaaaaaaaaattatttttgcaacttattaatgaaaaccnagtgtgccatttcattgattttttttttttttttttgaggcagtctcattctgtcgcccaggctggagtgcagtggggcgatctcggctcactgcancctctgcctcctgggttcaagcgagtctccagcggcagcctcccgagtagctgggactacaggcacgtgccaccatacctggctaatgtttgtatttttaatagagacagggtttcgccatgttggccagggtggtcttgaactcctgacctcagatgatccgnccgccttggcctcccaaagtgctgggnattnacaggcatgagccaccacacccagcccatttcatggattttaagttgttttgagatacttgcttttgtttttgttttttgagtcagggtctccctccgtcacccagagtggagtgcagtggtgtgatcttggctcactgcagcctcaaactcctgggctcgagctatcctcccacgtcagcctctcaggcagctggtgcacgccaccacagctggcttttttttttttttttgagacagtcccactatgttgcccaggctggagtgcagtggtgcgatctcggctcactgcaatctctgcctcccaggtccaagtgattcctgtggctcagcttcccgaatagagctgggagctggcgtgatctcagctcgctgcaacctccgcctcccaggttcaagtgattctcttgcctcaccctcccgagtagctgggattacagttgcccaccaccacacccggctaattttttgtatttttagtagagacagggtttcagtatgnttggnccaggctggtcttgaactcctgaccttgtgatctgcctgcctcagcctcccaaagtgctgggattacaggcgtgagccactacgcctggcctctaatttttgtttttttggtagagatggggtttcaccatgttggccaggttggtctcgaactcctgacctcaagtgatccaccctcctcggcctcccaaagtgctgggattacaagcatgagccaccacntgcggcnaattttnttgtattttttgtagagacggagtttnnnnatnnnnncnnnnnnnnnntgagatctttgaagatatcctcaacgtgaggtaaaaccaaactcctgantgtcctgtgctcccaaatgtgatctccttgtccgtaaggagctgagtcccttcccttggagagaagagtgtgccctttctntanatggctaaagaaacctcacagatagttcnnttttttccnttttttttttttttttntttggnagagactcagtctcactgtgttacacaggctggtctcaaactcctgagctcaggcgatcctcccgagttggcctcccagagtgctgggatcacaggtgtgagccacaaagcggattgctgctggggcttgctgttctcccgtagctcccctgcagccctgaccctctgggcccagagccctttacttgttatttgttttaatagaaacggggctcatagcagggcataggggttcacgcctgtaatcccagcactttgggaggccgcagtggcagatcgcttgaggccaggagttcaagaccagcctggcctancatggtgaaacctcgactactaaaaatacaaaaattagtcgggcgtggagtcacgtgcctatagcctcagctactcaggaggccgaagcacaagaaatgagctgagatcatgccactgcactacagcctgggtgacagagtgagactctgtctcaaaaaaaaaaaattaataaaaataaaagtaaaataaaatagaaacagggctcacgatgtttcccaggctgggttcggactcctgggccggtatgatcttcctgccttggccccctgagtagctgggactgcactgtggcaggcttatacctgtgttggtgcctaaacgttctagctctgcagactcaatttagccagtcgtcctgttccctccgccgcaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcctcccgggttcaaacggttctcctgcctcagccttccaagcagctgggattacaggcatgtgccaccatgctgggctaatttttttatttttagtagagacggggttttgccttgttggctaggctggccttgaactcctgacctcaggtgacctgcccgcttcagccttccaaagtgctgggattacaggtgtgagccactttgcctggcccacatttttattttcttttctttctttcttttctttttttttntttttttttttgaganggagtttcactcttgttgcccaggctggagtgcaatggcgcgatctcggctcactgcaacctccgcctcctgggctcaagcgattctcctgcctcagccttccaagtacctgggatcacaggcatgtgccactacacccggctaattttgtattttttagtagagacaggctttctccatgttaggctggtctcgaactgtcaacctcaggtgatccacccgcctcagcctcccaaagggatgggattacaggcgcgaaccaccgtgccccccccaacattttcattttcatctcatgaagaaaagttgatagaaaaaaagccaggtggttggtacccatngtttatataaagatcctgtcacagactccataggatgaaactcagctgtgaaatacgtgggattaaaaagagattanagtctgggcgggcagatcacaaggtcaagagatggaggccggcatggcggcccacgcctgttattccagcactgtgggaggccgaggcgggcggatcacaaggtcaagagatggaggccggcacggtggctcacacctgtcatcctagcactgtgggaggccaaggtaggcagatcacagggtcaagagatcaaggcagggtgtggtggcccacacttgtcatcccagcactgtgggaggctgaagtggatggatctcaaggtcaggagattgagaccatcctggccaacatagtgaaacgccatctntactaaaaatacaaaaattagctgggtgtgtggcgtgtgcctgtaatcccagctactggggaggctgangcaggagaatctcttgagcctgggagacgggggttgcagtgagccaagagcaagactccntctcaaaaaacaaacaaaaaaaagattagtttaaactttttatttgaaaattctcaaaattgaatggcataggccaggcgcagtggctcacacctgtaatcccaccactttgggaggccaaggcaggcggattgcttcaggccaggtgttcgagaccagcctggccaacatggcaaaaccccgactctactaaaaatccaaaaaaattagccgggcatggtggcaggtgcctgtaatcccagcactttgggaggccgaggtggatggatcacctgaggtcaggagtttgagaccagcctggccaacatggtaaaatcccgtctctactaaaaatacaaaaaagtagccgggcatggtggtgcatgcctgtaatcccagctactcaggaggctgaggcaaaagaatcgcttgaacctgggaggcagatgttgtggtgagccaagatcgcaccattgcactccagcctgggcaacaagagtgaaactccatctcaaaaaaaaagaaaaaaagtggaaatgtttgattatgtttaggttgaaagcagagttttgcatcagcgaaatggtttttcatgagaccgaaatgagcgtaaagcagaagcaagggtcaaggttttgcccagggaggacaagaagaactccccagaggacagtggggaatggagaggacagtggggaatggggaggaccgagaagctactcactaccccaagtaaccaggcgtatttttgtagggccaggtgcatgcccatattgattgacagggtctcactgtgttgcccaagctggacgtgaactccntgggctccagccatcctactgtctcagcctcccaagntagcataccaccacactcatctgcctcctttgcttttttttttttttttttttttttttttttttganananagtcttgccctgttgctcanactggagtgcaatggcaccatctcagctcaccgcaacccccacccttntgagttcaaaggattctccggcctcagcctcccaagtagctgggattacaggcatgcaccaccacagccagctaatttgntgnatttttatttttatttatttatttattttcgagacagagtctcactctgtcaccagggctggagtgcagtggcacgatcttggctcactgcaacttccgcctccctagttcaagtgattctccntgcctcagctttccgaatagctgggactacaggcgctcgccgccatgcccagctaatttttgtagttttaacagaaatggggtttcaccatgttggccaggatggtctcgatctcttgacctcgtgatccgcccacctcagcctcccaaagtgctgggattacaggcatgagccactgcgcccagcccttgttgtatttttagcagagacagggtttcaccatgttggccgggctggtcttaaaactcctgacctcaggtgatccgtccacctcggcctcccaaangntnaccaggattacaggtgtgagccactgcacccngcccctngtctttgcttcttaaggtgaaattgagatgactgaatcttagtacaattttttttttttgagacagggtcttgctgtcacccaggcggcagtgcagtgtggcaaaatcatagctcactgtagccttcaattncctcagctcaagtgatcctcccacctccancctctcaagtagctgggaccacaggcatgctccacaatgcctggctaattttttatttttttattttttgtagagacagggttttgctatgttgccaaggcntagtcttgaactcctgggctcaagggatctgcctgccttggcataccaaagtgctgggattacagacgtgagccaccatgcctgaacaaaactacataaatttttaattttttttgtggaaatggagtctcactatgtttcccaggctggtctcaaactcttggctctgtcctgccacagcctcccaaagtgctgggattataggtgtggcgcctggcccgtacaaatactttttattctaggcttaacnttttacattggccctagctaaatagaaatctcatcactcaggaattaatcctcatttaatcaaacngggtagnggtgtaatcttaggaaattattgattgactctacnctgattggatttgtagttaatagctaattagngttaataactaaattcacaaggcacagttttatttgatctcttttaaattgctcttaaggatgtaacaaagagtgcgtgggatgccctgagggcaggcattcgacttctggagcagcagcttaacttctgaaattcctccngaaccatgtgtccacacctcgtctggctgcatccgtgggccagatgtgggtggtgaatcctgtggattagaggtggtgctaggtagcccccaagtgactgcagtggtgggtccacaggcagcctgcagagcccgccctgcagcatgccagctgggcctgtgatggggcatccagagggtgttgccctgaacactcagcatgtctccgctgacacagtgtgctcaggctttgttaacatggggcctgttggctgcagagactcaggagttgagagtctaatttttggacctgctgatggttaagtcatagtgagtcagtgttaacgcgcaaagcgtttgacgagtccaatgntgcttccatactaagcagcaccaggtttcttttgctaaaattgaactcctgtgaaaaattcagagtgactaagttcattcaacaaagaccgtgggagcccgaggctggtaaacaatgagtccatcccgcatcccaggggactctggtggcagtgcagttttgccgagaggagttttaatttaaaaaaatgcaatcaggagaccagcaggtcctggaatgagtcaccctcagtgcatctgcggactcatcagacaccccaggccggcttcgggtggggaatgcactagaacgaagtgacacctttgactaaacngaggcctcccccgagtactcagagtggcccagacccctctcctcagggggctagcaggcttcagctctcatttgaaagggccgatatcaagcagagttgtgctgaggccagaaacccccacgggcaggtcctcccagggnctgggagtgggcatgccgtggggccggcgctgccaggacaggagggtggccacgagctccagctccnacaatgccaggccgaccctgccgtnggggctggggctgggacttgctgtgctctgttggcagncagctgttcctcagggngtttccaggctcttggagatcagggacactcatttnctcttgatcatggctgatacaagcatccctctctgtgtcaggtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctagngtccccagaccccacccctccntgcccttgatcnaagagaccagttcactactcagatgcacgtctccttggtgccttgaccattcatgtgacctttttggcatcacagatcaagtgtctgcagatgggcccagggcctgtaggtcagacattgnccnctttttccccagcctcaagcacaggggacacagggtgggctaggccagagcgccacctcctcagagaggcccctgggctccccactgagcatgatgagcctgggtgaggggaggcgcctgctgcggttgccccgggtggaggccgcatgtccggtgtccncttggtcattgctggntcttcgcctgggggcgggctggtcaggagaccgattgggtaacactcctgatttcggcttctctgaaacatgagaggctgcagtgctggagccactgcccagggtccctacctgcacccctgcctggcttgtcacatgctcntgtgtccagcctggtcatgcctgtccttttccccacctcccctccgntaggcaaggtgcccggcgacgactgcccgctggtgtggggccagtgctcccactgcttccacatgcattgcatcctcaagtggctgcacgcacagcaggtgcagcagcactgccccatgtgccgccaggaatggnaagnttcaaggagtgaggcccgacctggctctcgctggaggggcatcctgagactccttcctcatgctggcgccgatggnctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcnggtgtgttttgatatgaaaactctcnatgaataaacatctccgtgaaacgccaaggnccctcgtcaaaccctgagtcatgactgggaggagnaaggagcaggatcagacggtagagcctggggcatgctcttcaggcatgctcttgcctgctggattgccggcggcggccctgggaccctccctcaggctggctctgagggaccctggctgtgcaaagctggcggccactgcttgtggcgcctccagactgaaggccaccatctctgagtgggcgtccattgttctcactgggactgtctgcagcggggctgggcctcccacagtgtagggatcagtgtcctgacactgggaagtgtgtccacacgtctgaggcttcccttcctagggaaaggtggcccntgggaggctcctttgtgtgcctctgctccccnacaatcgtggtgggaaggggccgctgggggagtggcagccccggcatctcaggctgcttctggacagagcacaggctgtgtctccagtaacctagggagcccttggcattcatggggccagtgacccgtgcccagtgtctcttgacccttcctcacagcaacctgaggagtagaccaggcctcacctgaaatctgtgtcagggttctctagagagacaggactctatatgaagagtatatatgaagagtttattngggagtattgactcacgtgatcacaaggtgaagtcccacaataangccatgtgcaaggtgaggagcaaggaagccagtctgagtcccaaaacaaaagtagagaagccgatagtgcagccttcatcctgtggccaaaggctgcagagcccctggcaagccactggtgtaggtccgagagtccaaaagctgaagaacctggaggccgacgtgcgagggcgggaagcatccagcatgggagaaagatggaggccagattcagccagtctagtctttccacgttcctctgcctgcttgtatcctggctgtgctggcagccgattaggtggtgcccacctggattgagggtgggtctgcctctcccagcccactgactcaaatgggaatctcctctggcaacaccctcacagacacacccagtgacaatactttgcatccttcaatccagtcaagctgacactcagcattcaccatcacacctgggaagcatggaacccagaaacaagtgccagggctccagtgccagtgcctgtcctgggaagatacccaagagaagacatgaccaggaccttgggggagcatgaaatggtgagggcacagtgagcttgaaggctgatgtcacctgccaggagagcggctggcagtcctgcctggtgccccccaaggggcagagctggcagagaggggcctccaatcgaaggccaggagtcgtggagctccagtgccttggtgtggctggccttcttgcccccctcccagaggaccccgccagtaacagccctgctggtggaaccttccccagtgggcatgaaagaaatgagggccccacaagccacatggactctgatgcctggagccaagaataccccttagggtggtagaaaccgcccccggggcactgtgcagtgtggctggctctccagcatcaggagtactggggattgcctgggggacgactcctagggctgggcgcccgtgggccctcccctgctgccactgcggcccacgcaagccgggcctgaagggcgcgagcggcatgggntggggagcttgagggggcgttgggctcccaccaagcgccagatccttgcgcgcctccagcgctcgcccgcgcggctggttcctttgggatgcggaggtgcgacggctcctccgcgcgcgcccgctgcaccccagcccgcccgccgcccctcccggccctccgcagcctcggcccgccctcgccgcagatataaggcggcccaggcggtggctgctccgagcccggacgccgccgcccaccagtcagccggcgtccccatggcccggtccgcgacactggcggccgccgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgtgagtccggcgtgccggggactgatggggggcggcggcaggacgtgggtngggggtgcggcggcccctcagcctttgcttgcctgccccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccnccaccgtcccactcggtgaccccaggcccctccggcgcgggatggcgccccaggtctcccctactccgctcaccccgcagttaatggcaaacgaataaataaatgaggcggcctcggagtgaggggtgctggaggactggcagccaggccacgaggggaacgggacctggaaatccccaagcctgggtatgagaaggcagccgagtgtgcggcggcagggcaaggttggcctgggccgcccagaggtcttcagacccaggggcgaagctggccacgacnccagccccgcggtgaagccgcgcctagccttggtgctccctgggggaagtgcagggccacggctggcccggttcccagtgtcctcccccagcccttcgctccccaactcgagagccaaatctgtgagggcatgggctggagcccctggctgccttcctcttgcccccatcccttctggccaggccaagtccgagggtgcaggggcaaggaggagagttgggggcctgagccctggctccagaggcccagagcatgcctccccagagctgaaggtgggagatgggtaggttctccctccgccgttgggtgtgactccggaactggcttgggctctggcctccaatgctgctacggggccaggcccacctccgggcccaggcagcagcactgcagggcctttctaccctccccaagcctggggcccaggcagcccctgtccagcaccaatctgtctatggggaactggctggtccctctgctcaggggaccccgcagtccagggttctgagtgggagcattggcaccaccccactcctgaaagcgggggcctggcaggatgaggatggcctgtgccccccacaccttggcccctggctcggagagcagggtgacaggctgccttcctgggctgtggagagcctcgcgtgcacctcgcctccagctcctgtgctgggtcgtgaggtcgacctcacaacagcagaggacaggcccatggggtgccacatgggccaggtgctgtagggcagaggccattctggagaggaatgtggggctgaaaaaagtactgatcataagcctcattttgaatgcggcgagaccaggcaatctatggcctccctagacacctcccnggaggctgcagtaagaacctcttcggcctctgggctgctccaggcgggccgtgacaggggtgtgggagacagagatcccatggcccctggaggggccaaggggcaaggagcctcagctctggctctcctccttattctagcatcgcctgctacagggggtggccccaggctttggagggctggaggcctgggtttcactcactgccaggctgcccgctgcactcccggctgctgggtgcatggtgggggcagggccaagagggtctccttgctgagtggttccctnggtccttcccagcagggctgggagccccgcgcagcactgccaccaggctttattcggttgtaccaaagagatttccgtcagccatgtacaaacagaacagagtccataaggagagtggcgaagctgccgggaaggaaggcaagcgtgttttcctggagccaggcgctgggtggcaggacaccgtgttggggggtgcccagtgggaggntggtgtggtctacacccagagaactaaaggggtgaccgcagtcactgctccctaaagccctctgctctgcacctcccgccacagctgggtgggcagtcagtgtggcctctgtccaggtggtgggggcatccggggaccaggtgggggcgcacgcnaggagcggtgcgtttcaggctgcaggtgccgtctgcccgtctcacttccggncctctccactgtgctggacaccctctctgagcagctttgctggaaagagcggagagcctgctgcaaaccaggcaccttgtaggcaggcaaggaggcagagtcctcaccagcccttccagagccaggccagttagagagggcggccctgcagagtcctatgtccaaacgcagaaggcgcagaagcagagcagggggagggccggccagggcctctgccaggttagaagtcaccatcgcngctcccccaggggctgtgccgcctgctgcctggcagcctccaggaaggccagctccttggcttccttcttctggtttcgcgcctcatactccaacctgagagggcagggtaagtctagcagagagcgcccatgaggcggctccgagggggagggcacggtaagtctagcggagagcgcccatgaggcggctccgaggtgcccccnacccaactgcaccntgttggtgatgatccgctggacgatgaggtctgtggtgaggttgctgccactgtcaatctgacggaagatgccccttctcttgggctcctgggggtccagagaggaggagcgggatgaaggtccctgctgacctccccaagacccatctgatgccctgccccagagggagaccagcgcccagggtcccatgggagtggtgcagtcggagcagctgcgccaccatgcccgtttcccaggcaggcacagtgagtcattaaatggctgggaggtgccaatggcaacccctgtgcccagcaagggccagcatgacccacctggtatgggtcggagccatccctgtcangggnataatttctgtcttgccgtgacacaccaggtccacctggagnaaggagtggggtcaggagccctccccggggaggcagcggccgtcgccacccacagcccagcacaggccccgggggnttngggagagctgaccctgccctttcctcagcccaggtacctcctgggnccccgcctaggagcccacagccagcctgcattcccagcccatgcaggaancagaggtgaacagagggaacgaggtgagcccatgcggagcctcaccttgaagtgacttaggagctctgctgtgaccgcgtacggggctccaatcaccacttctgacacgtactgtggggacagtgggggcagaaagacttgctcggtccctgctactggtaagccagggccacagggtggtgagagacggctcagacatggggcggggctgccagtgagtagcagggatgggctgggcaggctggggacccctnggggctcctccatgagacaagaaggaacagcatctggagacctgaccacccctcctcatgcctcaacaaacaggtatgggcaggtgccacagaactcggggtgctgggtgcagctctgccagtgacccaagcccccctgccctggctcagggaggcccttagtaggggggantgttgntnggngaatgtctccccatccttgggctggctcctggcccccactcacccggcaggccagcacgctcagagtccgttcatgcagattcatgatggggtagttcttccccnttgtagtgattgacctcctgcggccagagtgcggctagctcagcccggagactttttggggggacagggtgtgcccctcccggnctgtccctcatgggaagaagtcggggaggttgctcgcccttgtggggatgccccagacaggacagccctggaccccagaagcctacngatcaccccccagggtctcctgtgacttcaccntggggccccttcccagagaccacctgcacctaacagcaacgcttagggcccctcgagggcccatcagctgcccaggggcccagggagcaagaaggcagtgacctggtcaaagtgtaagcccgcgatgatgtagggcctctctgccagcctgtgcaccttctccanggaagtccacatgcccgatgtctgcacccaggttaagaagcagtcgggatggggatgacagggagcagctccctgacagctcatgcccaagggcctccccgccatcctccctgctgacagctgctcccctgcaaaccagccagcccagtctgggggccccaaggagtcaagtgaggcccccgggtcccaccccatgtggcacatgtaggggagcagcagaggcccagaggatacggaacaggtcgaaggcaccagccacatagatgactgtctcccctggctggggctccttcccagnaagcaaactggatgatcttctgagatgtctgcaggaactgggataccccggtccaggggttccgcccaccagggcactgcaagccaagagagggagcaggttggcgggggaggcctcccaggtgctgccctcaccaggtcaccaaaccctcagctgtcacctgccagcaatcccatttccagccagtcatctcgggcaggggacacactgccaggccaggtggcaggtgggactgtggcgccaccccacaaccacagcaggcaccgcagcagacaccacttcagcccagcaagcgaccaccaggaggaggcaaggagccctgtggcaggtgcacacagcccttgggagggacctggtaccctgagaccactgtctggtcacctgggagcagccttctgaggaaagtatgtccccggcgggtatcgggtgagggggctacaatgggagagagggccaggccacttggttagaggccacctgntccacaggcaaatccttgctcctccaagcagtggctgccgtgaccggccagccggtgccaccacccgcctgccctccctcccagcatccaccagtgagccaaacctggcagtcagtgcctggtcagtgccagggacagagggaggagggtgaggctctgggctggcctttccccaagggatggctgggacaggtggccgggggagccccctgcagctgcgtgctcagctctccctgcacagccgcactcaccttgccaaaactgtctgcatactcccggtactcangaggacatctcctgcacagaaggtcagagcagggctgaggggcctgccctcccggcgtggccaccccagaaccggctggggatggggagcagtgggcaggaggaccctgagagggcagggaggtgcccctcctttcccctggagacctcgacccaggggcctcggggattccgccgccgactcacctggctgctgtgatgggctttggttaccagcagcatgcggcccacgaggtctgtggtggacaccccttgcgtgcgcttgcattctctgggggacacagtgggagtggggtctcatcctgggacactcgcaaggctctgcctcctgctaccaccanctagggacactagcagccctgctgtggcagnaacccacggctgccccaaagactgagggtccccttcctgtgcaaggccataacagaaaacctgggttgggaacantggggaaggcctccancgcttttattgactgaagggagtggcaggagcacagaaaaggacccttgctggggcccaggtgtgcaatgccagggagaggatgggcactggggtagcagctctgcttcctgcctccctcacacccacgtcctgcccgctgagcatctgcagctgagtgaattctcagctgcagcatctcatgcgggagccactggcctcatgtccctgacgtctggtaattcagatatagtgccagctccccagcagtgccagccacgtcccccgagctcaacagctgccacctcacaaagctgtgcctttggagccctnggggccatgggtctgcagcaccaaatggcaagggcctccaggccaccccacaatggcacctccatccctcgagttcccagtcctgggcngtgaggaacatggcccagggcctggacgctcccctcacgggctcccggtaaatagcaaagcacgagccaggagggagccccgtgtccagctccctggatggccaggcccgcnggtggagactcacctgtacctcccagcctgctttacttcctcataggtgtcccggccatctacagtcagggtgatgtcatctaagcagtgacacacaaggacaanggatccttaacccaaagccaccagaaccttcagagcccaggaccctctcggcccctggcctgccctagtgtccgcgtgcccatttctaggtgggggcccggaaatgtctcagatcctcaaagggcggaggccccctgttcccggatgtcccaccagcagatctgatcctgagccacctgatgtccccaggcccccaggtcccagccccgccactcactgccgtgaacacagaagtcacagttgtatttgtccagggtctctagtgtagtgacgtagggagccgctggcaccacctcgtccacccatttgatggcctgcaccatcttgtatctctcctcctgagtgaacaccgggggccccttgtgcttggcgatctcctctaggaaaaggacaacggggagactggggaccccagcccacccggcccctccagtaggaggccccttcccagcacccagctgtagccacacaagagggccggtgggggcaggctgtctctctaccctggcccttagcccactagtgctggccaactgggtggctctcttccctgcgagggtctcaggcaaaggcagagattccttctgacgagcaggtgctcagcccctgaaggcttgggagcctcgctggcagtggtggggagcnaggtgccccttctctttagctgggacaggaaantgcaagatgggaaaggcattaggccatcctcagctggggctgggctgggtgagcctacagtgccctcccctacagctgtgccctggcaaggtggccccaggcctgcaggctttcagtcaacagtcgcaacccacaggagggctggggggccgcgggtgggcgaggccatctgtgcttaccatcggtgtgcacgcctacgatgaggtagtcacccatggcccgtgcctggcgcagctggttggagtggccgtaatgcaccatgtcatagctgtggagacagagagagtgggtggtccctgtgccaagggtggggaccaggtgtccctgtgggttaggggcagagctttgctcctctgaggactccttaggaagcgctctgagaagctgctgctgggagccctgggactgnggnattcggaggatgtaggtgctcagctctccacccncnactggctcctgggcctgacggntgggacccctgtgccagatctagaaagggtggcaggggcagagatgtcaaggcctggctgggtctagaggactggtgggtgcaggacagactggagcccactgaaagctgcagggccacgtgtcctatcccctcaccaaatatcaactgccctgggcagtcactttaaaataagccgatgttaactcttggggtagggttggatcctagactaccttgagacaagcaaacagtccctggggctaacccaaaacaaatccaaccacaaaataaaaccctgggaatcactggccctgaaaatcctgtctctcctcccttacnggcctcaagctcagcaggcttaacgctaagggtgaacagccactgccttgccacctggctcgagagttttcattcacaaatctaggtctgctaacacgtgaactctcaagcccaaagctacacagccctgccaccaactgggcctcgctgccctggcttcttcgccacttctttacagcagcggcccatcccctcaagtggacaaagctgtccctgcctctccagggagaggtgtgaccctggcagcccacacagtgcacagagttgctccactgcacaccactgcttcctcccagcacccctgccacagtgcgcggangcccggcagacatgctgggtaaaatctggcgggcccatgtacccactggacaggctggaggggaggagggggcagaggctgggccaggggagcacagtctggaatggggctggggcctggtcagggcaaggntcaaagtccactgacacaaagccacattccttttcccagaggtgactcggacacagaagacaaggccctgcttgctctcctgggaagggctaatcagatagaggcgcttgcnttcctggattccatccggcaggcacgtgaaagggtcagaggtagcaaattatcagtaacggtcgtcttcctttcacttgttgacaacccngaaacttttcttaaaacaatgccctctgactggccagggaagaccgatcgcattctagccccgcggaggaggacccgggagcccgcgggcttcaccgcgggtcccggacaggcaggtcgcacccgatgcccacctacagggacgctcgcccggaggccaggggaacccctggaccggagccgggcaagctggttgctggtggttacggagaagcagggaggccgtggctccagatctcagcgcggtggctgcaccggagaggtcggcgtgaccgggcggggcctccgccagaggtagacggggtcgcccacggcagggcgcggagcctctgcagcccgaccctcccggcaggcgagccccgcagcctgccagccccggcccatgccggacgaggacgccacccagaacgcgggcccggtccccgggcancggctggcgcggcgccccggaaggaanncggccccggcgcccccgcggcccgccccggccccgcgctcaccagccatcgcaccacaccctcacggcgcgcctgccccccnggcccggctgctctgcgccgnctgcagccccgcgcccgttccggatcatggccccgcancggcggcgcggacagcctggcagctcccggcgantccgagcgccgccgnccgccccgccaggngcacgctcagcggccgtcacgcgggcctcacccgctgcgcacggccaatggcgtgcgcngntcggcccgagccccgcccccnccncccncnnnccgncnccnnnnnnnnnnnnngngncncnnnnnncnnnnncngcnncnnnncgcnnnnncgnnnncggnnnnnnncnngnncncnnnnnannnncncnnnnnnnnnnnnnncncnnncnatggcgtgtgccgcgctttccgagccncgccccccgacccacacctggcctctncgcaccgcccacanntggcgctcggctggcgnggcagtgcggcgtggggaccgtcccaccgccgccacctccgggaacctccacggggcgctgtcccaaccaggggagttttttttcttattttttggcacaataatctacagttgtcccctgtccaaccaagggagttttaagccacgaccgagctgccaggcggcagacctgagcccggggagcccgcgccgaccactcggggacaccggaagccagtgcagaaacngtttaatagaaataaaaaggtctgcatagagccgaggctcggagccacccctctgccgcacatccagtacagagaggattctataaagttcacactttttcattaagtagtagtagaaatacggtgaggccctgagactggcctggtgagcgaggaaaggccgctgggcgcttccactctgcaggccggggctgaaataacccgagttccgttctcacagaaaggtgcggctgccacctcttgacacagaggccggatgggcaggtgtcctcgatggccaggccgtatcagggtacaaccgcagcagtgcaaggggcttcctcaaggacaaatggctaaaaatgtcacggtgaaaatgtcatccccaaagagttcgttctccctagacccgtgggggcaacccagccttcaccgtgacactggccatctgcaaagtgccaactgttcttcatcgagcacgtgattacgtcactttcttcctttttgtgcgttttgtgcagcccctgccaaaccagccccctaggatgggggccgagctaagcggtgcaccccggtccccaggcggggcctcctctctgcttctgcacagcgacttccgactgtggctgccttcnttncancagcacgcaggggagtcgccagtgagaaaatgggatcctgccacctgccaaaaagggaaagcggcatcaggcgggcctgggagcctctcgcagtcacacctgccccagctcgggaaagctgtctgcggtccctgccttcccatccccttccctcccgtgtcaactgcggcggggctctggttggcggcagcttcattgttaccaagctgcagaacggatgtgggagaggtcacctcttaggtggtgactcaaaggtcggcacccacactagctcggtctcctcaaaactccgtgtccttgtccaccactgagcggcgtgcacacacagggtggggcagcagtggccccagggctgcctccgtctccagggatgagtcactagcaactctgggccccaccttccacttgtaccgctggggcaggtggaccagaccctctcccccttcccagctgactagggaggcgtggcctacagacgaccccgtgaagaaagcatgtgtctgacggagatgcagaaccacagatcataacttaagatacagatacgcactgataaggaaaatgagctaagttaatgtaaaaaaaaaatacagtacacgatagcccacatcacagaacaccacacacataacatacaagaagtgccaggcccagaaggtgaagggatccttaatttcttgaaccctttgattaaaagaagttattgatttcccctataagaccctgaaaattcacagagaaagagagtgtaaactttttactcaatacatacaccaagtctaaattatcacaaattctgtattaaggcacagtttgtttaagctttcccaaagtacgccaactcccaaaaccaagcacacagattctgtctgaccagagctgccgagtgctcgtcccctccagatgcttcccaccaggcatctcggagagctccacggggaggcctggagcaggagcacgcgggcagaatccctctccccgcggggnanttgtgtgtgccacatcagccagggcaggagtggcacacgcagggntctccgccaaccaccgaggtcaggccctctggagaccaccacngcttcagtcatgcctcaggcaccactgcaaacacctcagagcttcctccacactcagnctcacgagagaagacagacaaggcccagcacacagaggtgcggggaagcaggctgctgcagcggctcactcacctgctataggcggggatctccaagcccagnctcggccatgaggagccgcatgacgtcatcacacttcccatgtagcttcagggcagcccagtcatccttcggggtccactgaggacagggaaagccgagtgagagtaacagcagcccaacccttcccggtggcctgtcagccttggcccctacgggctcagtcggtgctccctgagcacccacgggggccctatcagaccgccctggtgcatgggtgtggggtgtctctggctgtgcgttctaagacccagatctaaggacgtggctctcagcacccgagttacctgcaggttcacgatgtaaagcttcggccgccggnctagggggcttggtcatgcaccagaggcgtgggtacttctttagaancnctgtggaagcagacagacagacaccgcacacacacaagggacaagtctgtacagtgctgggccgcagagctggacaccctcgggcaggcaggngctcggttcactcattgtgtcatcggcacgtaccttcaggctggaccctagacacaggatggtgtctgctctgctggcagcctcggtcgccgcnttcccagttcaaaggctgccccaacgtccccctctccccaaagtgcacaatggtgtcccgcagctgggtcccacacttgtggcaggtccggcctgtctggtgtctgtggagggcagtgcgctccgtcacatcgaacacccgcacgtactccctgttgggaacgcaggaggtacagacctagaggcaagagggcacagtgagtgggacccgcctgcccatggagaccctgggtccctgcaggactgctcacttcaatgtacatgttcccgtggagctcggagatggccgtgcgcggcagcccactcctcaggtggagcccgtcacagttctgagacaccacatgctgcacctggaaggcagaacgggtggcaaggggagggatggctgccagtggtggtggggaggtcagtacccggccacagcgaggctgttctgagccccgccgatggctcccaaaaccaggggcagctccgtccccccagagagccttagaaagtaaaacacacaacaggtccaaccaccaggagtcaagagggcctgtggtggggagngggctgtccttcctccagccctgatgcacctggagtggctgggagggcaagaggttgcaccgtcccggcaaggttgggaagtggctcggggtttggcaagggccactctgccccagatccatgctctcttgggtcatgacatttcaggtccctggggacctaggcagatcaaccactacaccccattggttgagggtgttcagcagaaggtccccagagatgtcctataagcctcccctgtgactaggatggcttctgaggtccacagaaaaatgcaagggaatcacaaaggggaaaggccaccagcagctctgaggctgaggctggctgcggatgggatggttcagagggggagctccccttctgtcctggagagtcaagcacaggaggatcaaacccgcggcctaacccgcttggtgggtgctcatcatgggagtcaactggcagacagagggcgggtgcagttagttgcccactgggcaccaaggtgctctgcctggtcccntggcaagtgtaccagccacccagggctcttaccagcttctgctcatgcagacgggtgatgctcatgtgggtgagggnttggctcggcctcgctcaggtcggcagcactgccaggcagaaaggaaggcaaggtgaggagagctggagctcaggcccgtgctgccgctgcccagcctatgtgggaggccatgcctggcccgcttacctaacgcttctccctttctgaagcagtgtccacactccattagggccccggtagtctgggatagacgctgcctgcatgtcgagaaaaaaggtaagccaagtcaaaaggcaccactgtaggtactggcagaattcccagaaacggaaagccactgtcactcctgccgcattccgggctggcctgcatgttggcctctattcattccacagngctgacctgcctgagcccatatggagtgtaccccaattcggctcctcccttctacctggacttccgtttcccgcctggcctggctcatccttccaggctgcacgcagccctgcctgcctccggaagcctctctggcaccgagcacaaagctgggctctgtggcacatgtgtcctccacactgcaggggaagactagtcatgttcctaaagtgcccccagggccgagcccacagctcacacatttagcaaatggtgaatccctaggtgggtccaggcgactgtccattctcatgtcccagtgctgactattcccgctccaccttaacaaaggcagaacaacttcttcagatgagatgagcatctaacttcccaggttttcaatcctgtgaaacaaactgaggcccacagagggcacacaagatatgccaggatcaaggtgtcttgtgttcccttttggggactcccgactcctgcttaaactcagaaaaatgcaccacccccccnggacagtagttccgacagtcacattcaagacgggnaaccntcaancactccgatgaaatccactagctgcatgtgcttttagttgccattggaagttccnatancaggtcacgtgactgttacataattacatgactggacttttttttttttttttttttttgagagacggagtttagctctttcgcccaggctggaatgcagtggcatgatctcggctcactgcaacctccgccttccagtttcaagtgattctcctgcctcagcctctcgagtagctgggattgcaggtgcccgccaccatgcccgactaatttttgtatttttagtagagacagggtttcaccgtgttggccanggttgttcttgaactactgacctcatgatccgcccacctcggcctcccaaagtgctaggattataggcatgagccaccgcgcccagcatgactggacttttacatgtgacttgtggagggaggagactaaaccccagggctccgggtatttgagtcagtagtgaactccctttttgcattcttgctgctgagcctctgctgttctttgcttggagtgcctcattccaaccttctgtaaatctcacccatccttcaaggcccaatcaaggccacctcccacaaaaagccaacgcaggtgggtttcccaactccaagagcgcagagtgtgtgtctgagtttgctctagcgacccagcacagccagctttacagtatggttatttgttcacatgcctgatccttgtcacctaaaagcttcctgagaacagaaatcacctgggnttcagatctgctaggccgacgcgtgcccaacaccccacacacacccatcaaattagatggacgaggtgccagctacactttcaaagctagtgatngtcccacagcccaggatanacttgtncagtgaaacttctcaaaacacaatgcaattctctccttcacctggtgtattctggctcttactgtgtcactttctacttatcttccnctcgacatggacagaacangagtggaaaatcacaactttgggcttagctctgtccacataacctgggggtgcctgcgagcagtcggctactacaccccattcgtatctctactccttgttttttttaactggctgtaacacagaggccaagcgtttaaaaagcgtttaccttaggtaagttttggtcatttcgtttctnttaagagaaaaaaccttagagctgctttaaaggcgagtttttcgcgattactnggagctcatactccgtcctngggtacgcctccgcctccctccctaccgtgctgattcccgcgcctgtgtagacgaccaagtatttggcgttccggacggcgctggccagctcccggaccttcccccgcagctcctccgggtcgtcgcacacctgccaagacgccagggtggtcaccgccccgggccgccccacccgggaccgcccgtcgccccagctgctcccgaaaccgggggcgcccgcgcgccgcacgcggaactcgcctcctcctgccgccgcttcaggccctcgcgccgccggctccggccctgcagctccgttaccaggtccgcgctctcggccagcagccggccctcctcggcgctgcgctccgccgccgccttcctcaggatgcgcgacacctgcgggcaggcggacggtgagcggcggcgcgggccgggcatggccgggccggggagcggcggcggcgtacctggcggaggcgctccctctgctgctcctcccgcaacctccggacccgctccgccgctttgcgctcggagcggctcagacccccggctgccatcgctcccctggagacctgctcttccgcttccgcctcacacggcaggccgcgctcagggcgcatgcgcaagatngggccccgcccccacccaccccttccggctccgcccgccgcgtcgccccaaagaagcacctgccagtctctttaaaaggtttattgatcatatacaaaataaagaaaaccttatatatcacaaacatacactatgtacagcaataaatacccggggggccaggcccagtgctgcccctcctggacaataatttagcaataaatactgcgcagggcaggggtagggcaccaaggccactgccctgcaagaggtcaggcccctgcccgccctacacgaagtgtgagcgctcgggcctcaccccgcatccaaaccccagcccctcctcacttagatctttaataacctccatcccaccccagcagatcccggggtcttctcccacacacacaacctcccctggctagacctaggcagggcaggcagggactgatcaactctgcttggacccacctctcagcgccaggagagcaacagggctggacacgcgggcagcccttgtcctgttgccaggagaaggctttctgtgcccactcccngtttggttaaaggcttcagggactagcagattgagggggtgggaagaagggcagggctgggacacaaggttgctggaggggccaaagcccnaactggggtcaccaagaacagggaggtctcacagtttatcggggacacactctagctcagactcaagggacacccatggtatcaaagctgctgctccaggggcagggtggaaatgtgtgggactggcccagcaggtatggtacacacccaggacacaggccagaggcaggacaggcattagtctctcagacacgccctgcctctgtgtggcactgattatgtactctactctcccgacctgctccaaggccagacagccaacaggaaggcaaaaatacaccaaaaagaattattcagtggcttctgggggaaaaatcgttaatgtgttggttcctttcaccaaaccacagcctaaaaaagtaactcacaagatcccagagcggaaacggtgcagcaggctgcggctccgactttccagatgtggatgggcgctttggccaagtggccactccagagggaggcagcagggacaacatgggacctgaccatcgtcccaaagcaggctgcagccgctcagggccgtgggccgggncccntgatcaccagtcagaagtgtacacacatatctgaaacatgcaccaagagctgagccnagcaacaccagtgccaccccgagcagcagccaggggcctcactctcctggtgagagctgacctgtccctgctgggtattcctctgaaatctgagcgtccatgttaggataaaagaggagttggggcaaagttnaaggtggaagggaagacatatatcatggtttacttggcggacaagtttgagagacctggccttggccaaagccctcgattcgctgtgtcagaaaaactgaggtgagaagagaccaccaccctnctccaccaccctctcagntaggaaagcgggatcaacagagatcagaaggacagcacactcacacctgcacatgaacacaccatctatgtcaggaaatccaggggaaggggaaganggggtggagtggctccgcagggctgacctgacaggggacaggaacactcccctagacccagggaagtcgccccaaatccaaagctcttgaaaggaggtatggcctcgaaactccagaagcctcttctgccaacgcaccgaggacctgcacctcccattcagcacgcgtcgacccttacaccctcctcttccacactcccttcgcctccaggtctgcagcctggcagaggtgctcaaaatggatggccacccacagccaggacaaaagtgggggctgcacaanggacaaggagggcctgtttctccccactccgaggcagatcatgacgttttcttcatggatacttatgatatgattccaactaacgcctggattctacttagacaagatcagactgaggggagggggatgaagtcactaaatgacanagagtcaacagccaatatttccattttcaggctgacgcaggtagacacaggacttgtctctgaacacctcgagcaaagaaaagctcattaacatgacaagtgttgatggtgcctccctgttcccatcctgtgggcacaccaggccaaactattggataaaaatcccaccatccatagggttaagccctgttgggccacagtttttcatcttacccacatctgtgtgctttacagaagtctgggccccacagaaaagaaaccagcaacccggtgaaaggccagggctcacatggccagacacagggctgtagcctcttggaggtgggtaggggcaccccctccnccatcatatgcctacaaggagcctcctgagcccagccaggaagggcagcagcctctggcgaggaactgagagcaggaggcaggctgcgcccccacagggaggcacctccagcagaagccaagcagctgatccnctggaagacacagatcccaaagggaggcagaaggcaggcccgaagccaagagctgccagcgtggaccagcggagaagagggacaagacccggnccctgngagactgntagcccnttgtctgcactggtggagacccccaaggctctcagagtgaggcagggacaaggaagaaagggcggtgcccggtgggcccccacccactctgcctggaagcaccacccgcagcatggaaacacctcagggatcaagcgggcggcgagacctgcagcccacggcgcgggcagcctataggaacaaagctgaggccagaggaagacggccagggaacgcttggccatagccctgtggccacccacagtgactccctcatccctgtaatgccaccacccaaggccagaggtggtgggtgtggaagcagcgtggggcgccccaagggaccccagtttcacctaccccgccactagatcagcccaagccctagacacagatgtagccaaggctcagtggaggggggcatgacagaaccccnatgtctcacctcctacggaccaggagctggtggtgggcacagattccttgagctctgacgcagcaggcgccacttggcaccccagcccaggtccagcaagccagcagaagcaaaagcacaactaaacccaaaaaacgaacacgnggaaaacagacacaagaagtgacacccacaggtcaaaggtcaccagaagcaccagcactttaccgctgcacaaaacctcaccaggcacggacgacaccacggcaccggcaagagacggaagcaggaagggcagagngagtaagtcacntttcggtacaattgcaaaagatatcaaagaggacggccttctggtcggctcacggcttggcttttttttttttgtcttttttttaaactaagttttataaataatgtctgataactctgtgtatataaaaactaaactccaacagccacaaagaggtgtccgtaagtttacaagaaagggattttttttctttttttttcttttttttttaactagcaaagtttctattatactttcttcccttttccattcatatggtcaaatggtcttcttgcttgttttttttctaaaagacagttttataaatactctgcagctcttttttctttaacttttaaacatataattaatttaataactttgtaaaaggaacttctctcttttaaataaagggctatataaccacacaaataggtcatgtaaacagtgacacgggacccatcgcagggcacactggacccaccctcacgttaagcgcacaaccagnagatttggtcttgttcagtgcaacgggtcaggcctgagtgcacagcccctgggcccagctgcacgcccccagcaccactgcgcccaggctggtggtccacccatcagggccttcaagcccgccctactctcagagcagagcccatctcttcatgctgggctaagctgagctgctcccctggggctaaagagagtgaatccttcccagcccgcgagcctgtggccnactcgggagtggagggaacactgggaccctcactgctcggggacacgcgaggcccagcgtgcctgctccttctctctcccgcaactctctctagtccgttcccacagcaccaactctggactccaagcctgcatggccctggtacaaaaggggttggggcgaccccacgtcaccgccgaactgaccaatcccaacatacaaaacacacgacgacnatgacgagatcaaaggggctcagcccggcgcccctggggtacaggttgtgctttgcagggaangagagaagggtggggaagagagggaggaaagagaagagaaggaaacagagggacagggcagccaaattcgccatgtgcctagtggccccgcaaagacccgcctgggcagacgcgcgtccctacgatcgggcatccgtcttggactttactattgtgatgacgctggtggcggccaccttgcctgggacgaggggccccaggccggcggcaagggggccccgggctggcgccacggggctgcgggccaccgtccgggcgaaggtctgcagcgcctcgtacttggagcgcagcgcgtcgagctccagcttcatgctggcgttctctgaggccagcttctccacctcctgctgcagctccgccttctgcttctccagctcctccttctgcgtcacccgcttcacgcggcagctggcagcgtagccgcggttcttgagcgtgcgccggcgctgncttcagctggacgatctcctccttggacaggccccgcaggtgctggttcagctcccgcaccgacatggtcaccagctcctcatccgtcaggctggtgccattctcacccggctcccgcttcacctggggcacagtgcaggtggtcacaggccaagcgggcacgcccactgtgccccccgaccccagcccacaggctcctgtccctgcccactcaccttcaaggccttgtttcctttattgggggtcgtcataacccgggggcacagcgagcaggcgctctctgcaagacacggagcaggtcagtaccctggagaccaccctnngcnngcannccccccccccccngcccccggnncagttcacaagagcccttgccgcacagcccgccccagcctgctgtccaggtgcccagcccccaatacctgataggaggcagcccttggcctctcccnaggctgggctgagctgcttcnctgtccaccctgcccctagagaaccaggtgggaggtcaggaaggtctgacgggagaaggggaactgaaggctgttaggaaggcaggcgcaagacaaggggcaggggagagattagaaggaataagacgcgggagaggcaggcctagaaggaagccgggagctttaaaaataaccccggcactgcccagagcgcggctgttcctggcgagtcacgctgactcagcacattgcctctgcctccccgccgcgcccgcactccctggcccgccagccaacagcgccccacgagagccgcagcccccagcctggccaatagcaggtgagggccagccagtgaccctgtgtgtgcatcttccagnggtcctaccttctacagccacctcccctgagccggcctcggacaaagccccctgctccctgggtgcacaggggccccacgggggacctggccagagaggaggctacagggaaccccgagtctcccagcctcctaactttgaaaagcntgggggtgggccgtccatctagctctggtctgttggcaggactgaccagggagttcccccaccttccaggtggcaggccatcagctgggaggagcctggcccgaggcccctctagacctcccagtcggcctcctccactgatggagtaaccatcctgtggctttgggttgcaggnaagcagcccctgccccaccccatccagggtatttcacaagggnctcccacagtgagccaccccgggcctgcccaacgtgaaggctggcggagtcagcccctccgagctgcagcctgctctctggtccctgccnccgggtgagtgcccacagggccagggagcaaaaacaaaagtgctggggtggccggacttaacaaccaactcttccccactcggggtccctccagcactctgctctcactttcttgnctaaggatgtttctgggattcccagctcagcccagctcccaccagacccttgggcatggacccccgcctcatgctccatcccccactttccaggtttgatgcagacagatgggagactcctccagaggagctaggatcacttcaggaaattatgggctggggggcttcttactctcatcaggggagctgaagtgtggccaggcggatgcacacatcctcaccaggctcaagactccacctcacccnagcctgggaccaggaggtgaggctgcaagcacagagcagggaggggaggccagagacccctccccacagccanagccagctcagaggcaaggtcccgaggctccagccactggattcttccagataaaggatggggaangacctgagctggaggtcagaaggcccacaggagccctttcctacacgtccggcacaacactgccccaggagacaggccctcagccaagcatggaggggccccccagnccttgagtgcaagtcagggtgcagagacactgccctggcaccangcttctncccacccccnatcgcccccacccctgctgctaagcacaatgacagtggtgacttcctgaagagatcacacggaaaagtgcctcctcgacagattttgccctccgcagaaggcctgaactcagcacanagtgcaagnccatcgncctccntatcaaanggtgncgnccnggggggtgggggnnaggggcagnccctgagcacagccagtgcgttccaggctcctggcctggcctctggacctgggcntgagagggaccatgcagggatcccaggagctggactgaggagaagctgcccccgccctcctccagccctcaaggctgggcagagctggggcctgtcatgcaccctctgctcccagaggctaataagcccacctcacgcaggaggcacagatggtcacggctccgcaacctgcgagggtacctaggccacccattcacactgagagccaggaaagggagggagatttgggagctccgtctcctttggctaaagtagaaactcccgtgcctgaacacagacagccccacctggctgcaaagcccagcggccgaaactccccggcagtcatggcctctgctccataagctctcagctcctganaagtcactctttgaacagaacctaaaacttagtttccactgatgcataagtganctgagaagatgtacataaatgggccgcgcggtggctcacacctgtaatcccaacanctttggganggccgagngtgggtgngattacgaggtcaggagatcgagaccatcctggctaacacggtngaaaccccgntctctactaaaaatacaaaaaaatagccgggcgtcgtggtgggcgcctgtagtcccagctactcgggaggctgaggcaggagaacggcgtgaacctgggaggcagagcttgcagtgagctgagatcgcgccactgcactccagcctgggcaaaagagtgagactccgtctcaaaaaaaaaaaaaaaaaaagatgtacataaatgtccctccaggaccccaaaanttttcccagggcatcaaactccaggccaacggtcagctaaaacattgaaacatctggaatctataagccccggggctcactgagagtggancctgtgttctgtgtgtatgtgtggggggtgctcactgagaatggacctgtgtgtgtgtgtgtgtgtgtgtgtgtgtgtggcggggggcggggggcatccctgagggcaaaccacaaagtagcctaacccagccatgaaatgaactcctgggcaaaggnaagtcaaccttcgtgaatctccacatacccaaggaaaggtggctctggccacatcactcccaagctgccactttctaagcgtcctgggctgccaggccagacacccaacagggccactccctttgctaacttcacacaacgctgagaccccacttcaggtagcgacaactttagggtggctgggtgctgcgttctgccaccctgtgccatccacaccagcccatctgctgcaccccaaggctaggcaccctgaagctcccaccacctacagtctcaacccagactccagggccaactggggagagaggctgggctgcttcctcccctttgccgtttcctggtagagctgcccctgcttcctccctgcccagcccactgtcacccagggcttggtacacacacccctctttctcccaggacctcgatctctggccaggggctgtccaaccaggccagtcccagggaaagccgacttcccctttggctagctcggcccaccgaagctcctcccctccctcactcagggaactatttcccagtttggaaaactgctccagacttgggaccaggaccagctgccggaaaagagccgcctgggaaggggtggaccgcccggggcttcacctttgaccccgggagaacacctgcagcgagccacccccacttcctcttcaagcacccctgccnttcaactggatcgctcggcgctcacttaaacaggcaccccaaggcgccgggcctggccccctcccacatccccacggctccctcccacctcccgctggcggccttttagtccccgaggcccctcgctcgaatcccctccggtatcagcttgagcaccgagtgacctcacgctgatgactcagcaagtctccctccgggctctggcacgcgactgacggaacccgagccccagccaggggcagggtcttccnccgcagcacccccatcgccgcccctcctcccgggctcgccgcggacccccgcgccggggagagctgacgcggccaccggatgaatcagcagctgcgggccgggccgccgggccctggcgcggacccccgggcgcctcgctcgaccccaccctttcctcccngccgtccagtgcccctccctccaggacgcccgggtctccgagtccgctccgcactcgcccggctccgcgggtccgccgccgcccgcggcccacctccagtacccgggcgccaggggcaggaggagctggctcctgaccgctggggaaatcgaggcacgggccgccagcanggtgcgcggcagacccgaaaccagcggcccccgccgccgggcccccaaccgcccgcctagctccgggaggagccctgcctgcgcgccccctcggnnccnnnnnnnnnnnnngnnnnncnnnnnnnnnnnngnncnnnnnnncnnnncnnnnnnnnnnnnnnnncnnnnnnngnnnnncnnnnnnnnnnnnnnnnnngncnnngnnnnnncnnngnccnnncnngnnnngnannnngcnnnnnnngnnnngncnnnnnncnngnnnnnctnnnnnnnngcnnggnnnnngcngannnnncnnnnannncnnnnnnnnncnnnnntngnnntncnnnnnnnnnnnngnnncnnnnnannnntcnnnngnnnnnngnnnnnnngnnnnncnntnnnnnnnnnnnnnnnnnnnnnnnnnnnnnnnnnnnnannnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcccaccagaggccataaacagatagttcagagctatgagaacccaggtggctaaaaacatgaaaaacatggtctcaccagtaatccaagaaatacaaaacaaaacagtacggccctggcatttgcgaaacaggccctgaacctgcgaggtgtggccaccgagaccgacaggcaccacagcctgggggggcgtcggccagcgtgctccaggaagttcacaccttcgacctgtgtgttccaccctggacgagccatcccagagacaagggagtggacaaaactcagcgcccaaacacgttctcacagcattgttcataatcagggaagttagggcacatttaaatagtcaacatcagagcagtggttaagcaaatcccccagtgcctctcagaatcatataattgttgaaagaatgaatggcggactgtgatgtagcacgtaagtcacatggaggagggggtctgaagatcacggggatgcctgtggccatatcgaaggaagagcatgatgggaaaatccatcagcggctctcaaggacagagcaggggagagtgacttccaggaggggaagaagattccagatgctgatggggtgctggtgagcagtgcacacgcttgtcaaaactcatcaaactgcactaaaggtctgtgctttgtattgtgtataaattatgttctcataaagttgattaaaatctattatgtaaaattatatatagactttccctccatcttaaaatatataggaaaaagacaaaggaaataggttaaaatatcactaatggttcatttggaataatgagatttggagagttggacaatttcttcttcttactttgttttccgtggtaggtttgctcagtggtggcccccgcaaaagaaacgtttgcctcctagcctctgaatttgaatgtcaccatatttgggaaaagggtctttgcagatgtaatcttaataagagatcttaatatgagatcatctgagattacttggtttttagtaagtaacctttaatttttagaacaattttaggttcacagcaaaattggatagaagttacacaggtttctcatatcacacccccacacaggcatacaacctccccttatcaatatttcccatcagagggtacatttgctacagtgaatgaacctacagcgacacagcatcgtgacccaactccgtggtttacatcaggatttactcttggtgttgtccattctaagcgtggacaaatttatcatgacgtgtagccaccgtggtagtgtcacagaacagcctcactgccctgaaaccctctgcgcttcccaggtcacccctccctcccccagctcctggcaaccactgattttatacggtctcagttttgccttttgcaggatgtcatatagttgggatcatacagcacgtagccctttcagattggcttcttagtaatacatttgagtttctttcatggcttgacatctcatttcttttcagcgctgaataacactccactgtctggatgtgccactcacctactgaaggacctctttgttgttcccaagctttggcaattttgagtaaagctcctataaacgtctgtgtgcaggcttctctgtgtacatactttttcggttcatttacctaaataccaaagacagcgattgctggattctatggggagggtatgttccattttggaagagacggccagactgtcttcaatggtgctgcactgtcttgcgttcccagcagccgtgaacgagagctcctgttgctacacatcctggccagcattttgtgttctcaaaacacattctggccactctaatagatgtagagtggtatcattgttttaatttgcaatctctagtggcgtatgacgttgaacatcttttcataggcttacttgccatctatatatcttctttgatgaggtgtctgttttggtctcttgcccattttaaaatcaagttgttcatttttttattgttgagttttgattgttcttcatgtattttggatatcagttctttatcagatgtgtctgtggcttgccttctcattttcttgaaagtgtctttcacagagcagaaatttctaatttcaaagaagcccagcttatcaatcatttcttccatggatcgtgcctttaatgttgtatctaaaaagtcatcaccttacccaaggtcatctaggctttccctgtgttaacttctaagagttttatagttcgcattttacgttaggtctatgatccattttcagttagttttgtgatgggtgtaaagtctgtgtctggatttaatttctgcatgcagatgtccagttgctctatagcctcatttgttgaaaagacaatttttggccacagtatcgtctttgctcccttgccaaagatcagttgacaaaattatgtgagtctatttcaggactttatcctattctgttgctttatttgcctattctcatgtcagtatcttgattatggtgtcttttgcctctctctataaaccttagaatcagtttgtcaatgtctataaattaacttgctgggatttttattgagagtatgttcaatctacagattaatctagaacaactgactcgacaatatgtgagagggtctccaaaaggttcatggaaaatgcatattatgaaaaaatgcgtagatttcaatttcaaaataaactcatactaccttgttataacacatctgaacaggctctagtttgaggcactaagaagaataggacagcagtttcaaaagagcccctatcagggcaacatgaattctgccaactgaatctttgagtttctcaccattaagtaggatgtttgttttagttttttggtagatactctttaacaagttgaaaaaattctcctgtattcctagtttgctgagagtttttaatcacgaataagtgttaggttttgtcaaatgcatttttgcatccatggatatgatgatgagatttttcttctttagcctattgatgtgactaattttcaaatgttgaaccagccttgcatacctggaataaaccctacttttcataatatataattatttttacatattgttgaatttaatttgctaatattttgttgaggatttttacatgtatgctcgagagacatttgtctgtagtaatatctttgtctggttttggtattagggtaatgctggcctcatataatgagttagaaagtattcctgctgtttctacattctgggagatattgtagaggactggcataattttttccttaaatgtttggtagaattcaccaatgaacccatctgggcttggtgctttctgttttggaaggttattaattattgattcaatttctttaatataaacaggcctattcagattatttgtttcttcttgtgtgaattttggcagattgtgtctttcaaggaactgctccattttatctaggttatcaaattggtgggcatagcatttttcaaaatattcctttattattcctttaatgttcatgggatctgtagtgatgtccccctttcatttctgatattagtaatttgtctctctctctttttttcttagcctggcagaggcttaccaattttactcatcttttaaaagaaccagcatttgtttttgttaatattctctataattcctggtttcaattttattgatttctgctctaattttattatttcttttattatggttagtttggatttaacttgctcttctttttctagtttcataaggtggaagcttagacgactgatgttagatcttcttttctaatatttgcattcaatgctgtaaatttctaagcactgctttaactgtttcccataaattttgataagttgtatttttatttttatgtaattaaaaaaactttttagaaacagggtcttgctctgtcacccaggctggagtgcaatggcatgatcatggctcactgcagcttcacactcttgggctcaagtcatcctcttgcctcagtctcctgagcagctggtactacaggcacatacaactgtgcccagttaatttttacatgtttttgtagagatgggggtcttgctgtgttgcccaggctgatctcaaactcctggcctcaaatgatcctcatgcttcagcctcctaaactgctaattcaaaatattttaaaatttatcttgagatttctttttttttttgagacagagtctcactctatcgcccaggctggagtgcagtggcacaatctcagctcactgcaaactccgcctcccaggttcacaccattctcctgcctcaacctcctgagtagctggggctacaggcgcccaccaccgcacctggctaattttttgtatttttagtagagacaggatttcaccgtgttagccaggatggtctcgatctcctgacctcatgatccgcccgcctcggcctcccaaagtgctgggattacaggcgtgagccatcatgcccagctgaaatttcttctttaacccatgtactttttaaagtgttttgtttaatcttcaagtatttgggaattttccagctatctttctgttattgattttgagtttaatctgttgtggttggaaagcaaacgttgtgtgatttctgatttataaatctgttaaaatgtgtttcctggcccagaatgtggtctctcttggtaaatattcaatgcaagcttgagaagaattctcaatctgctgttgttgggtgtagtatttagatgtcaattatgtccagttgattgatggtgttgttgagttcatctgtgtccttattgattttctacctgctggatctgttcatttctgatagagggctgtggaagtctccagctctaatactggattcatctatttctcattgcagtgctgtgatgtttttacctcgtatatatttggcactctgttgttaggcacatacacattaaggattgttacatcttcttggagtgctgatcctttatcacctgtaatacttccctttgtctctgatagctttctttgctctgaagtctgctctgtctgaaattaatatagccactcccactttctttgattagtgttagcatggtatatctttctccatccatttacagcagatcttcaaataacatcattttgttcaacatcattttattttgttataatgataataagttttgtgcattctccccatgtctgtgtgggttttctctaggtattccagttcttcccacaccccaaagatgtgcacactaggagagctggtgtgtctccatggtctcactgtgagtgtgggtgtgtgtgaaatgtgccctgcaatggaaaagagtcctgtccaggattggttcccaccttgcaccctaagctgccgggataggctccagccacctgcaaccctgagctggagtaagtggattgaaaaataaatgaattattagtaaagtattttaaaataacaattcataaactatatgacaatcataaaaatacatgaccacaaataatgtggtacaaaagtgctcatcaagcctgccatgtttgctactgtttgtttttgaattgagtggtggtaggaggtgctcctcagaattttcagtttacaagcatttattccttgatttaacccaccaccactatgaccactgtcattgatgattcctcaaaattgagtaaataattatcttacttgttttaatctttcttaaatgtatgtatatcttacatttatttcaatgtttaatattataagtattttgagcctatatttagaagtttggtgatattgttgtgaccagaaatatgtcacaaaaaacttaactcttgtgtttatcaattagcctataggaaaagtggttttgttatacatcactttactcaaaaagccacagtttccaagaacctaccactgacgtttagtgaagacttactatacttttaatctatccgtgtccttctatgaaagtgggtttcttgtagatgacatatagttgggtattgttttctatctactctgacaatctgtcttttgattgatgtatttacaccattgacatttcagggattattaacataattgggttaatagctgctatattgtttactgctttctatttgttgcccttgatctttgtttctaattttgtcacacgttttctaccttttatggttttagttgaacattttgtattctttcattttctctccattctgagcatatcaactgtacttctttaaaaatttttttgtgtggtttcccttgagtttgcaatatacattatacaataatctgtaagtctactttcaaataacactatacagtttcatgggtggtgcaaatatcttataataacaaaatatttctaattcttaaccctttcttcctgtatcatgactgtcattcacttcatttatatgtgagcatatagatgcacacataattcagttcattgtcgctattattttgcactgttttctgtttgctaaattaaaaaaaagacaaagtttttattttacttcatttattcatgttccagtgctctcccttactttatgtagcttcaagtttctgacctacattattttccttctccttaaataatttcttctaatatttgttgtaaggaagtctattggcaaaaaattccctcaatttttatttgtttgagactttatttttccttcacttttaaaggataatttcgcagggtactgaattctagtttggtgtttttttctctcagcactttaaatatttcactccactctcttcttgcttatacagcctgcctgcctgcctgcctgcctgcctgcctgcctgcctgccttccttccttccttccttccttccttccttccttccttccttccttccttccttccctccctccctccctccctccctccctctctccctctctctctctctcttttctttttctttctttttgaaagcctgttgcacaggctggagtgcagtggtgcacccacagctcatcacagcctagacctccctgggctcaagtgatcctcccacctcagcctcccaagtagctgggactacaagtgctcaccaccacacctggctaatttttgtgttttttgtagagatagagtcctgtcatgttaccctggctgatattgaactcctgggcttaagcatcccacttgcctcagcttcccaaagtgttgggattgtaggcatgagtcaccatgcccagctgcttacacaatttctgaggagaagtcagatgtgattcttatccgtgctcctccacaggtaaggtgattgtttccctctgtctttttttcaagactttatctttgactctaaagtttgaatgtggtacacctaggtggtgtttttggttgtttggagtttttttttttggcatttattctgcttaatcttctcaaagctttctggatttatggtttggtgtctgacattaatttggaaaaattcttggtcattattgcttcaaatttctttcttctccttcttgtattcccatcacacatatgctacaccttttgtagttgtcccagagttattgaatattctgttttttttttttcctttttctccttgcttttcggtttgggaagtttctattgtcatatccttaagctaagaatcatttccacagccatgtatgtctagtcagctaacgaacccatcaaaggcatccttcatatctgttctagtggttttgatctctagcatttcttctttattctttctcagaattttccacatctctgcttacattacccatctgttcttgtcattcctgatctgataatttcaacattcctgccatatctgactctggttctgatgctattccgtcttttcaagctatgtcttttgtcttttagtatgccttgtaattttttgttgaaaggcagacataatgtactgggcaaaagaaactgcagtaaatggccctttagaaatgtagtgatccaagctgggtgtggtggctcacgcctgtaatcccagcactttgggaggcccaggtgggtggatcatgaggtcaagagatcgagaccatcctggctaacatggtgaaaccccgtctctactaaaaatacaaaaaattagccgggcgcggtggcaggcgcctgtagtcccagataattgggaggctgaggtaggagaatggcgtgaacccgggaggcggagcctgcagtgagccgagattgcgccactgcactctccagcctgggtgacagagcgagactccgtctaaaaaaaaaaaaaagaaatgtgttggtccaacatggggccaggagaggcattctctagttctctgaacaggtctcagccttttgaacctgtgtcctggactgtgaacttcactaatgcttttcagtttctatcccccttaaaggttggacaggatgactagaagggcctggggttcggtatttcccttctcccaggtggtctgggctctgataaaacctcaacaggcaaggctgattgaatagtttctgttgggggcagccttgttaagaacagaaggctctggcagactttaaaatgactcctttccccctcccccggctgagagcatgaggggatttctctctgatattcactgtgaggacctggtagggctcctggagataaaatccacaaaggcgtgtttcccataactgggtcccctcgagtttttaactctcaaagttgtccacactgaaccgcaattcatcaacttcatccaggttttcttatgccggcactggttccagtggaggtttctgctcttgggaagctgtgattctctgtatctgtcagtgtttctcttcaatttgccggggggcagcagtttgtcctgtgacctaatttctctgaaagatttaagaagagttgatttttcaatttttttcagctgtttacttgttaggacagagtgacaacttctaagttctacatgtatttttaattttgtgcattagatttttgatttctaaaaatcttaattggctgtttaacaaatctatctgtcattttcatagttttctgttacttgcaggtattttcaagttgatcttttacttctttaaacataatgataactaaaaataatatgtgtctgataattccattttttaagtctttgtggatttttgcttactattttttctgccagttctaactcatggtgccttgtgtctttgtatatgtagttatttttcactgtgagctgctcatgttgcttatacaattattgggggaaattctttgagtttgagatgaatgtgcatcccttcacagactgtatttgcttttcccaagctcctgtagccccatcaatctgaaatctttttaaactaattccacagcctaaagatttttggactcccaaggaacagagtctctgtgcttggaggcggcccgggcagcctggcttgtccagatggagctcacggccggggcctcgcctgtgactcggtgtgggcggggcctcgcctgtgactcggtgtggcccggggcctcgcctgggactcggtgtgggccggggcctcgcctgggacttggtgtgggcagtggccaggatgtgaccatggtgagaccaggccttgccagagcgtggacttggcagacacggctcctcccttgtgtgcggtgggagcttttggtgcgttccttacgttggagccggcatggagaagcagggcggtccctggggaccagctcctcatttgcacccctctttttaattaagtacattgtttatttttggtacctacttgtagcctagtttagggcccaccgcatattctaaagtgatgcacccaatggtgtccagagacagactagcctggagttggatggggggccagtctggggatgcaaaggtctagagaagcccaggccaagggcaggcagagcagggtgggagtgggagcaggaggggatgctgggggcagtggcagcacatgtgtcccaaaccactgcctcctaggtggggtgggacgggccccaacacaccacctggctgtgccccgtgtgggggtcaggggtgcagcgaggagggctgggtgagcagtggggtcagcagtgcggcgaggagggctgggtgagcagtggggtcagcagtgtggcgaggagggctgggtgagcagtggggtgaggggtgcggcgaggagggctgggtgagcagtggggtgaggggtgcggcgaggagggctgggtgagcagtggggtcgggtgcggcgaggagggctgggtcagcagtggggtcagcagtgtggtgaggagggctgggtgagcagtggggtcagcagtgcggcgaggagggctgggtgagcagtggggtcagcagtgtggcgaggagggctgggtgagcagtggggtcagcagtgtggcgaggagggctgggtgagcagtggggtcgggtgcggcgaggagggctgggtcagcagtggggtcagcagtgcggcgaggagggctgggtgagcagtggggtgaggggtgcggcgaggagggctgggtcagcagtggggtgaggggtgcggcgaggagggctgggtgagcagtggggtcgggtgcggcgaggagggctgggtgagcactggggtgaggggtgcggcgaggagggctgggtgagcagtggggtcagcagtgcggcgaggagggctgggtgagcagtggggtgaggggtgcggcgaggagggctgggtgagcagtgtggtcagcagtgtggcgaggagggctgggtgagcagtggggtgaggggtgcggcgaggagggctgggtgagcagtggggtcgggtgcggcgaggagggctgggtgagcagtggggtcagcagtgcggcgaggagggctgggtgagcagtggggtgaggggtgcggcgaggagggctgggtcagcagtggggtgaggggtgcggcgaggagggctgggtcagcagtggggtcagcagtgcggcgaggagggctgggtcagcagtggggtcaggggtgcggcgaggagggctgggtcagcagtggggtcagcagtgtggcgaggagggctgggtgagcagtggggtgaggggtgtggtgaggagggctgggtcagcagtggggtgaggggtgcggcgaggagggctgggtgagcagtggggtcggggtgcggcgaggagggctgggtcagcagtggggtcagcagtgtggtgaggagggctgggcgagcagtggggtcgggtgcggcgaggagggctgggtcagcagtggggtcggggtgcagcgaggagggctgggtgagcagtgttggcctcttccccgctctgcccagtacctagagtgctgccacgtctggtgaaggactcagtaaatacttggtgaaggatcagatgaagaaggaaaagttgtcagtgctgaggcaggagaagccaacctcagcatctgagcctgagtggtggtggggcagggtcctgcccagagaaaggtgatccccttcccgaggggagggctggcacggtgctcaggagcaagggctgcaggcccacaggacctttgttcatctgacctgtgtccccatgccaggctctgtcccaagcgggctgaggcagatggcctaggcagccgtcggtgaaccctccctggctccagagcctgtgcaggccccgtgggggtcaggctgctgtggggggcttgaggaccctcacttttggcccctggaggccccgacgaggcggcccttgaggttcaactggacagtattcccctgacccctgagcagagtgtggcatcaagaccccgacagtgaggccagtcccaggccgggattcggtgccctcctttaacgtgtgtgcgagtgcccacaggcctcactcagcctagaggaaggtgggcttgcgagctggggcctgtctcatgctttgcctccgtggcattggctgcgcctcactcctgcactgtggcttccatgtgttgaaaggcgagttccataggtgagaacagctccctcccagcacaccaccggcctttgctcgtgtacagtatttacccaatgccggtgaacacgagcagcctccatattcttgcaccaaggctggagaaggacccagcctgcaacacagctcatgaggcatcaggggccaagcacctaccgtcttgatgactgggggatggtgcccaggtctgtctgcccccactgtccagtggatggtgtgggaaggcattgcaggctggctgagcaggttacataacagtgcacacatgggtttactttacttgaaaccctaaaccctctgcaaacagccccctccctaatccctccctgttgactctgtagatgagcccagggtgctgaaagatgcagctgcatgcctctgcagccaggcccagggcctgcaacatccttcagccaaacgtgggtccctggggagcctctgtggcctcgccggtttcgatgaaggccagaggactggctgcacgggttgcctcagctctgcctgcctctctgttcgtgcctctctcctacctggcgggggtgtctctgttggcctcagagatgtcgctggtgctcaccctggtcacactgaccactgggcatcctcccaccccctgggccacttctgtctctgcacttggcttccctgcccacggcgtgccacccaaacaaagcccacagagaggctggcgccctcctcagccagatgcctgcatttaatagaagatgcagagacacaatctaagccaaaggaatgaatctctagtggtgaaatagcatctggtaagaggagagatttctgaaaggaggcccctttctccttctcgcccctccttgctctggaggctgagtccagctgttcctcccatgcccctgcccggagggcaacgtgcaccagggcctgagagcacagacaggtctaggtgggatccgtgtcagcaccgcagggcacacgaacgactcggcaggctccagagtttggctcattttctgcttggtccctttttgatgcctgtgatttatttataacaatagtttgcataattccaaatgtggtgacacagcctgcagacgctgagtgaaatgaagacagaacagatttttcagaggggtagtggtgtggagcaggctgggccgcgagtgatagaactgagccccaggttgtgctcggagtctcctggtgccagaacactgggcttccgtgggacctgaggggctgaaacggtgctggacctggacccttcctcacagtcaccctcaggtagcccatctcagacaggaggggaccccttgtcccccatccccatgtttggagcgtgctgagctgcacacagtcctccctgggtctgagaccgctggtcctgcccccaccccagctctctcccctctgggtcttgggtttcagctgtgatgtcatcctgcttgcctggagtccagaggggttagctggggggctcttgtttgcccagaattccttgtggctgtccagtctcagtgcccactgtgatgcctgaccctccgtgagagccagcactcaggtcagagatcgtaacctcccgagtgctgagtgtctccggcgccgcccaagctcagggcatgtttgtgtctcagttcagggcatgtttatgaattgacaaatgaagttttggaagaggacaagttcacatacacttgaccaccgagagatagagggagggtttcacatagctctctaccatgggggggagcggttttcccctggggcctagtgtgtggccctgtccaagctcacccagcctccccttgagggagcaccatagattccggatgctcagaccatgttggaagctcaggcctttggaacacctcagatcctactccagcctttctagaagctggggtttaatatatcttagcagatgggaatgtcctgtcactcagagaaaaggctgggcaaggtctctctggggatgaaaccacttagcgctcttcttttgggggatttaagcgcaaatgattcagaaacagtcaggcttcatttcttgacacggggctggaggaggtgagaagggcgttgaccaaatgaaatttgggtttggtccaagtcagaaatgtgtgagatgaatggggacaggtttcccgagcccatttaggtctgtgcacggttaccaacagcagcagcggaggccggggcaccagggtggggctcctgaatgggacatgaagaagggttaccccttctgccataagcaacaggcagggcagattttacaaacgcgttttctagcattgtttctttcagcccaaaagagttctgtgagttcatcttcagaaatcaagtttctgagaggtggggacatccaaggacactggagattgggatgtccgggaaaacggggtcttcaggcccgatctctgcccaccttccatgccctttccccagcctgcccctccagggtgcagcctccccatgccgacgaggttccctggcacaagcaggctggtgtgcatgtctgtgctttggctgcaggagctgcagagagggtgatgtcaggtccatgttgtgtagagagaattccgacatcgcccagcaggtgctcgggtgccgtgtccagcagcttggtgggcttcctcagcccctcagacccccaaaaccattttctttttttgcatccatcaatgtcccgcacaggagcaggcccctcccaggtgaggtgggcttggatgcaggagggaagtggtaaagacccctcccagagacaatgcagaattggcctacacgggtggggcattggaagccagctctgggggtactgactcaggaagatgtgcctcagctgagccccgggcattaggaattggctgcaggcatggacagtggacacggagcagggaggcccaacgctacctgcctacaggggagcctgggacgtgggcttctgttccgcagcctgcagagcctgctggagccgggctggtgtcgaggaccacctggcgcccagcaggtccccctgcagcttgttttctgggaaagcaatggactgaatgcctgtgtccccccaaattcatgtgttgaaatcaaccctcaaggtgatggcatttgggggtgcagcctttaggaggtgatggggtcatgagggcggaggctcatgaacggggttactgcccttacagaagaggcctaagggatgcccctctcttcctccacatggcacagtgagaaggtggctgtctgcaagccaggaagagggccctcaccagaacccaactcagctggtaccgtctgcagcttccaaactccagaactgtgagaaataaatgtgtgttgttattaaatcgtcttggtgttttgctagagaagccctagctaaggcaccttccgttctcccacctcttcctcctggggcaaggcctgggtgaggccccgtaagccagcgagtggcttcaagctggtggcacagccagtttcaagccgtctctggggtacgtggcacacacaagagccgggctgtgtaacctgcagcccacggctccacagaggggctgtgccgcccagggacactttctctgcaggtctctggcttcaaccctccttgccgcttgtgtgccggggtgcacttttggggcagctggcagccttttagcctcagctcctctgtggggacagagccaagactgatcgcaaggccaagacctaggagtccaggggaggccctcggctctgtccttcctgccggcccggctcctgctcattccactaacaggcatctccctgatgaaatcctcgagaggttagtcctgtctcggcggcagctgctcagagcaccgggctatcctctggcccctccgaaagcatggccctgaatcactgggggagcctcaccaggcagagatggctcatccccatggacctgggcccccgggtcccggcccccctggcctggccagcacctgacgctgctgtgaggagcatatggtcaaatctgcacctgctgccggccacaagggaggagcaagtgctgagtgcccctgggccacctgaccaagaggtgtccttgtgtcccttgccccctgccccagacgtgcctctcgggaccttcaggccacggtgctatttattacccacttgaggacaaactcggagccaacccacaggcctatgtggcaggactggccacacctgggcccagacacgctgcagctttgcgactccggccacagatcccggggactgactggggttgcaggccttgggccagcccctgaacctggccgtgcctcacagagctttggtggggatgacatgagtggatacattcaaagggtttaaaacggcgcctggcacactgcatccgtgctgctgtgattctatttgagttggtgctttccagatcggtttctctctgtgacgatccagaatctgtgttccgtgcccaggcccaggagtgaggagaggccaacagggaggagaggagggctcctgcctcagggaaacggagcccgtgcaggaggtcctggccgggcagcatggggctcaggacggatgcccgtggcgggtcaccccccacagcagtcacagccggggggcccccaggcctcagggttccacggagcaggttgggcaagtgtgttaggaccatcagcaacctgtgtgcagccaaagacagcaaggacagagccaggaactccggcttctgcctcctctccctgtgccgcctctcctggctgagggctggagagagaaggccacggagcgagagtggcagccctcaagggacgcaggctcagtgctggctgcaggggagctgcgagggcctcaggcgagggagctgcgaggaggccgctgcggcccagtccgtctgttccctgagctgatgacaaaccgtttgttttctgtgaaaggtgctttactgggagaaaggctaacagtgaggcagctctgaagtgcttttattctcagtttcctctgtcgcttaaagaccacttcacatttctttttatttacacggataaggatggatgagcttgatgttctcccaccttcctcttggcgcagctttcttctcctccctcttggaaggactttcgctttttattattattttaaacgttttaaacaacaatctcccaggcgcccaacaaaggcgctactggtgccaggtgcttggcgcctgccttccctgacaatacacgggccacatcctcagcccccccggctggtggcctgtgactcccgccccagtgccagactctttatttcattttgttggcatggtggaaaacactggcttttcaggaggtgaccctgctttcaagagccaacctttggagaaaacaggacacagaagctggttttggctgtgaggccctgacgcacggatgcaggttgcacaggccccacgtcctcctcacagcctgcctttccagctggctcaggagtccctgcggcttgagtttatccagaagcttccctttctcccgcaagagctactcgtggaagagaccagttttaagtgattttgccgcatttgaccttttgggtatttcagtgaaaacaaaacctcttccacaatgcaaaaacttggattcaacaaccatcgattattccctctgggcacctcacagagctggggtgaaggccacctggggttcacgggactcaccgttgggtgttggcattgagtcttgtagagcagggactggcaaagtcagagcacagggcctggtgtgaatcccacctccttccccgactggccaggggacctgcagcaagcgctcagcatctctgagccttagtttcttcctctgcacggggagctcagcggtggcacccacttcatttcagtggtgcccccttagtcatggatgatataaaaatgttgccacaaaagtaaccaagacaggtcgggatgagatatgcacgacttctaaacccaattagggattaattaggaacatacaataaattcccccaattcataagaaaaagacaggaactccggtggatgaatggacagatgatattaataggcaattttcagaggaatttaaagcagcagacagatccatcatacctgccagacaggtgtgcgctgcctggtgtgaccctgctggaggcagtgagggcagcagggatggcagcacctggcggctaggactcggccaagctgaagttcatgcacccgagagccacagcctctgccccagacagggatcagaagtagatttacactcccctctgaaagaacaacaacagagaaaacacacaaagcacatttttcaaaaccctgggcatcggtcgcccgcactccgccaccgtgagtacactgcgtggacccagaaccttgactcctcttgtttctgtgaggctgggacttacgggtgatgtgcagaggggccagagctggtatttagagaggaaatttgggggcaattaaaataggggttctcgacaagtctggcctccccgagcccaggaccaccatagagctctgaacagaggaatgagctggtcgccgtgagaggcggctttgccagagctgggccagggggaaacagcccgttcaatcaggacttggggggtgggactggcttggggttggttggtgtgaggcggggagaaggagatccggaagagtcctcgacggctgacattcacgtcactggagggggccgattggaggggtcagcgatgggctcaattttgtgccctcttgagttcgaggtgtctgtggggcctccagctacagacatttgtgtgttggaaaagctctgcaaaccctgaaacctggggaggcccctggtcttgtctgatggttgtaggtcatggtgacctccactagggcatcttcactcccctgagccacactgagacactgggtttgattgagactctccagccatgatgacaagggttcagctctggtaagccatgtgcagcctccccctcaaagaccagatgccacccacccagggccccaaacatcctggcccagcgggtctgctcactccttgatgagcttaccttcctcgatcaccccaacatgcagagagaaaccctttgcccttcttggagggaggggtcagatgctcactctgcagatccctgaagacaagcagatgctccctgagtggcctgtctgagggattcagctggcagctgggtatcctcatgtgtgcagttcctgagtgagcactggtggtggggaacaggcctggctttccatgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccatgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctcgggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctgggggggtgcaggggggatgggcctggctttccacacccggggggtacagcggggatgggcctgtattccacacctgggggtgtatgtccaccacccagatgccacctctgtgtcattcctggagggcattcgggcatcacctgagggtggggagcactgccctgacccacatgacccccagcagaagctgccactgtcggccctgggctccgggtgtcagcgtggcgctctgggcttttcccacactggggggccatttcaggatgtggatccctccaggaagggcttgctgagtggctgctgtttgctgggatgggtgaggggtagacaacaggcactcaggagccatggttgggacagaacttatgtttgtcagccaccttggaggggcgacctggagagctcggacaaccttgcagcacccaccagagagcttagcaccaggacccagcagagctctcccacgtgcacacagactcactgctcgtgtgtgagaaggggaataagtgtgactgagccttctggaagttagggcctagcacagagggtcccagatggcccggagaaccaggtcctgtgcagctatccagagaaggtccagtcaccagagacagacagctggagtgccagggccctggaggtatcaattgcctttgttttacatgaagacattgaacttccacaggagggcaaacgccctggctaaagtaactggcggggcagcgtcaggaactcacaagcccctgtggtccgtgcaggctgccgtcgatttgatgagcacagcaggtccaggcagagagacgctcacctccagctgcggttggggtatgtctgggaggcctgtggggtggctttgctcctccaccttgggccagggtagcctgtggcaaagacagtctcacagtgtgtagtctccttgaggtctgggcctgtccgcagacaggaaataatgagaccggctcaggacagggccgggctggcctctgtgttttgtgaaagttcgagtttctacaccctctgagaagatgctgggccctgagggagggtgtggaccagaaggaagtcacggggtgagtggagggggagggaagcttatgtgccattttaagaagacgacagcaaaaacaggaaaatcgtatttatctgaatcctatgtgattccacttgaattttaaataatttagacaaaagtaaattggcgtttacttttgcattagccataaggagcagaaggagaaatttgctccctagaatatgagtgttgacgtgttgctgacatcaaaacagaatttaaactttgaggaaagagagatgccagtgctgccacaaaggcaccgacgcccgagacagcagggctcgtgtttcttcacgcagaccatctgtgccgccgttggccgtcggaggtgatgaaactgggctgcttccaatgcattccagaatgtaaacccctcaccgtgtttcttcttggtttgatccctggagtgcctgtgctttgtcttcaagtcacacttgggattttgctagttttccaagattatcgcattttttttgaacaaagtaaatcagtttccgacaatgccactgtcgtgttagggtttctcggcgtgtcgcctggctctggccggggttgtgtgtgacgcttcctacccgtgctgccttgcacatttatggagcagggggtttgccggcagcggtcttggttccttataatcctgtcatcgtcctcgtcgtcagccccctccttcccctgctcttcctctgttgtcccagcaagactttcaaagaaccagctattgctcaagtggtcttttagagaatgtgcacacctctcaaccactccacaacacctcaagattgcagtggttgtgtttcgggttcacatacatgtatatcgagactcagggaagtccagggccacacaggaagtggcagagccaagatttagacctgatctagctccaaatcccagcttctctgttgctggccacgcaggatgagctctgtttcccaggcaggctgagcaaatgtccaggatggcaggttcttggcagggccctgggggctgaggccacagaaggcctcctcacaggagtgggggtgaagggccccaggtccaggctggatgaccttctgcccttcctgatgcgggtgacctggctgtgctggtttgaagtaaaaacgctgttggcagagaatcgagacgcggggaaggttagttcagggcagggatgttggtgtctgcgggtgatgactgcagcctccctgtgtgttgtgtttcccggttggcacacctctgtttattgtctgcgccagcctcataccccctttccctcagcgtatttccttcataacaggatggcagactcagcggctgctatggggctgttccaactactgaaaacactgagataaggcccacggtggcagaaatccctgaggctgccaagggtgcccacatcccagatgccggggctctgagagtcgcctcctctgttcttagttgcctcggatgtgaacaggcggccatcagggggtgtcatcctgagccctgaggtggggcctggggtctgcactcgaattcacggtgccctgatgctaagttttaattcttaaaaagcttttctagctcaagatactcctcaatatattaattattggctgaaaaaagcctaaatttttaatcttgcaaatgctagaatttctgagctccctatgttttctctcaattctgctgcaagcttggctttcctttctgagcttatctttttcttgaggtactttatcaaatgcagtagcaatgattattcactctagagacattttgcttggaaagcttttcacccaatgccaggattacattgggtatgtttcctgctttctaagttattacaggagcccatgttagtgattttttttttaccattacatgtcacaagttgccattccccgactttctaaagtagtttattcaccacccagtctatcagccagtgccacatattaatactttaggttttattatggcagcacctacttttggcaccaaattctctattggtcagctattgctataataatgctgtgtaacaaatggccccaccaatcccagtggtttagaagaagctgtttgtctctcatgcctatgtcggtgtagtggccgcagcatctacttcaggctgcaggtgcctctcaggtgtgtggcttggctctcattttgagacctgatggaagaggcagaaggtccccccggggcacttcccaggccaggcgtgcaggagggcaagtggaagcacatacttacctgtactcagaactgcccccactgtccccttccacacttcagtggtcacagcaagtcccatttccaatccatggtgctgggactgggagggaaggaaggactgtgagtgtacaatgccacctgccacaggaatggctcaaggatggaggcaaagttaacaccaggagttgccctgtccctctgctcctgaagcccttggctttgcagagatgatgtggtgcagtggaaaggacacagtgcatggcgggccagctcggctgccctgacacactgtggccagctggcctctcctcggtgtccctggagctgcagctttgatgccagggtagaagatgagtgggaggcggaggggcatttccagccaactctatacactgagaagcactaaagattaacaggtgactgtctgggaagagccagctttgtaagagacactgagaggcaccacttcccaggccttcatcttccctctggatgggtggaggaacagggacaccaaacctgacattgctcccatactgagtgccagccatggccccaccttgcacagcccatgcctcaagggggccatggctagcactatctgacaagaggatgctgggcaggtgggtgggagcagaggaccaggtgaaggctggggcctgtgtaccccagttgaagggagctagatttaactccctgagacccaagaagcatccgtctggccaccccagtctaattggctaggaatttggtggtggcacaggtgagaaggtccctgctccgtggagcttgcaggttctggaaacaaccccaccacatctgttgcaacacctgcagccgtcttcttgcatctttgctttgtgctggacgcttccatatggaacacctaacacaacatctgtagtgggctgagggtaaccctcaaagatatatgtccacatcctaattcccagaacctgggactgtgaccttatttggaaaaggggtctttgcagatttaattaagtgaagggtattgagttggggagaccattcttgtctatctgggtgggctctagtccactgataagtattcttagaagacagaagaggaggaggccatgtgtccacagaggcagaggctagagtgctgtgggaccacgccccctctggcagctcgtgaggggccacgcctcctctggcagctcgtgagggacccacaacagggaggactggggccttgctgggctggagagcccagaggaacaagcagggggctagggcccctgagatgctgtatgactggtccattgttcctgttcctttcccatagaagaaaaaggagagtagtttggggacagattcatgcacatatgcacacatacatactgcacacacatacatactatatacaatacagtgggtatacatatagacacactacagcacatgcacacacacacacattctgcacacaatactgcatgcatgcacatacggcacagcacatacatgcacacatgctgcagcacacacaatactgcacacagagcatacaatcctgcaagtacaccatacacgggtgaagagaaggggcatctgtcagtggcctactcttccagaccctcattttgtccttacagcagctctctggggtgggcctccccaactccctttaatggatgaagatgctgagacttaagggttacaaagtctgcttgaagtcacaaggtgctgcgacttgagctcagggccaggtgaatccctgatgttcctggcaatctgctcctgaagggtgcagcagggcctctctggtctggttctccctcttcctgtaacctttgaggtagtgcctgcaggaaccctgggacccccccacccccaccccaatttgcctgctcctgttccctgggctcagcagagtcaccatcccagccccaggacaagtgtcctccttggtgggggacatgtggtcattgctggggcgatacagtgagatgtggccacacagccatgtccagaccttgggcaccatgctgctcatgctccagactgctggggagcacctggtcctggttgtgtctggctttgggtccttcaatttctgctgtctgctttcctgtcattgctcccacttctcaaccctgccttggtagcttctctgatatgatcaggcaagatcttagagcacagttgcatgtttatattatagcttctctatcactcctgtgggtgtgcacatgttgtatggtgtgtgtgtggatgtgtttctctacgagtacagagcacatatgtttgcatgcattctgtgtgtgcacaaggcatgtttaacatatctggtgtatacacagggtatccataaggtttatgtggtatgtgtgcatactgtgtatggtgtacttgcaggattgtatgctctgtgtgcagtattgtgtgtgctgcagcatgtgtgcatgtatgtgctgtgccgtatgtgcatgcatgcagtattgtgtgcagaatgtgtgtgtgtgtgcatgtgctgtagtgtgtctatatgtatacccactgtattgtatatagtatgtatgtgtgtgcagtatgtatgtgtgcatatgtgcatgaatctgtgctctgaaaagaaagccaacacagtggctggacaacattctaccagtcccttgagactatcaaaagtcagtgtgttcagtcacacagaggagcctttgaagacttcagatgaatgactcaggagcccctcagtcatctcagcagaagacagagataggactatgtgaaaggcctagggaggaccttcttgtgaaatagagtgaatcctgtgtgtgacatacacaggagaccacaaagttcttgagaatgttatatcagcagaaacactgccaacttggactgaagggaacagagaaagtatgaaatgaaagatgaaagagcactgttggactctccaaaattctgcaggaaggaagcaggctgataaaaccactcagtggcaaacatgtgctacctttcatgaaaaaggaaggatgactccaagggtggagccatgagcccagatgttggacctgggacccacagaggattattttctcaggccttgaaatctaatgtttgcttagctggtttttcaaagtgcttgggactgaggactccttttttccttccattttctccctttttgaatgagaatgtctataactgtcaactgatgcctgtcctaatgttgggtctgacagcagatcatttgtttcttgagttttgcaggtttacaggtggagcagaattatgcatctggatggattataccctaacccaaccctaatttacattatgaaatttgggacacttgaactaagtaaatttagatgagatttctggactttgacttaatgctgtaatgaggtagatgttcacagatgctggggtggagtggcatccttgtgagtctttggaagccaggggccaactgtagtcagcaggataatggcccccaaagatgtccacatctcactccccactaccttatatgtcaagagggagtttgcaggtgtgattaaattaagggtcttgaggtgggggattatcctggattaaccaggtggccagtgcaatcatgaaagtcctcacaagaaggaagcaacactgttagcatcagagaagatgtaactacggaagcaaaagtcagagtgatgagtttgctttagaggtggagggaggaacccagaggcatggaagataggtaacctctagaagctggaagaggcacggaagtgaattctccccagagcctccagaaagaagagactcttgctgacgccttggtttagtccagtgaaacccatgtgggacttctgatttccaaaaccataagatgataagtgtgtgttgctttaagccactaagtctgtggtcatcggccgtagcagcaataggaagcaaatacaggcatgaacatcaaaagagcaggagacgggcattccggaagtcgcaggaagaacacgctttctactgctcctgttgggtgttgtcgatcagccaagatgagggctgagaactgatgccagggttagcctttgccggtaacatcggcaaaagcacgtttagtggaataggggaggtaaaatctagcttagcgaggactcaggaaagaccaggaagagaggaagtggagaaggaagactgtgttcttagaggggcatcttgaaaaagagcagagagacagccagcagctggggggccctggccggcaggagaggggacagcatgactgttgttgagggtggccccactgagggggcaaccagagctcctggccagcctggagtgggggacggcggtgggtctggctggccaggcacagttgggtgggaagatggtgtggtcggagcacgtggacattcttttctgattgcttctattttctcagtgagatgggaaacaatcatctcctttttgctaaatgtgctgagcaggcttgagggatgcctggacttcagcaggaagcaatagtcatgcctcgcacatgcggctttcaatcctgtttggttggagaaataatataccgcccaactagtttgttttaaattagacaaacaccccggagcctgcctgctgctggagacggctgtgtttggagtggggctctcggcggtgctgaggtcagctctgtttgacattcctgatgtgtgaagggcgcacttaggacaacaccaccaggccacgggcgtgcagctccctggagctgctccaggggccctgcctgagaaatgttccagtccttgaaatttctccccagttttaaacatctgttggtgcttgtggaaaataaggtcgggattgttgtgctcaccgcccgtgaaagctgccattgcacggtctgtaaagtgctggtgatgaacacttcacaccgacaggctgagcctcggccctggccacgtcgctggggcccagcttctgatcagtctgtatggttcagctctccgtggagttaagtcatgacaaccaaggaacacaggcatttgaggggatagctctgttccctccgccatgtcctggggcgagctgtgtagacgtctgttatcttgataaacccaaacctcttggggccaggtgccctgtgccttcctttgtccttctgtccacctggccttccatgagcctctggggtggggctgtctcctttctctcctgacttcccaaagcacaactgaaagcaaactcttccacccaccatgagtctcattccatctctccagtgggcgagacacgtagtgttttgttttatttcatttgctttgttttttcaatcaagctgaggccagcttggaggcctgttttccttgggatggtggacacatggatctcaggagtttgggggtgccccttctggtcgcaagggaccttctggaccctgtgcctccctcccaccagcctcccctgacaccgcctccgtgctgctcctctcccggtgggctccaccctcactagggcttcaaacctggaatgctctttcctggcctcctgcctgtccccttcccaccaagccccccagttcctgctgagtgccacttcctggctcagctgctcccatccagtgctgggctcagcctcgtcacccacgccccaccataaagggttctttacagcagatggcatcgctgtcggccccccaaccggaggcgcccttcagggcaggagcctgtttcttgtggaagtgtcttaagccctaaaacggtgcccagtgcacagttaaataaaaatcagagccccaagagcaaaccttagcccctcacggtgactacagcccttccaaagaggggccatatcacgtgcacagtgaccctctccacgtgggtcccttggtttgtgagggccttggtttgcaggccatagactgacacagtggcacctggtgtgaggggaagagggtgtggaggccacagacccacacggtggtacctggtgtgagggaaagagggtgtgggggccacagacccacacggtggtacctggtgtgaggggaagagggtgtggaggccacagacccacacggtggcacctggtgtgaggggaagagggtgtggaggccacagacccacacggtggcatctggtgtgagggaagagggtgtggaggccacagacccacacggtggcacctggtgtgaggaccttctgaaggtacccgtgggtgaggggatcatttggatggattgcaaaatggccatgtggctttagtgacacctttaggatgtaataaacttcagagtcaaccttaattctgggagagagacatcttcacttttctggtgccataactgcctctttgtggaacgcaaagcaaaactaaagtcatttttcttgtttgtttttaaggcccttcaggctctagggtgagtttctggtttgaggggaaggcctttcctcctgactccagccctccttgacaaggtctccgtaaagcatgctttctcttagggaccctcagagggaggcttggtggggacatggggtcagggacatcatcaaatgctagacgcccggctggggctgccccgagggctctgagaggagggggcaatcctgcgtggccaggtgggtggtgagtgtgacctgggtggttggcagtggcttccgtccaaggtcctggccaggagcggaatcccacagccacggcaggccattagtggctgagtgaagtttgttcagggtggcctgaccaaaggcaggccctgaggacagctgttgctggctcttggtggaaagaggctgaggccaaagggtttataggtgttcaaattggaaagtggaacaggagacctaagtacgctccctctgaccaggttagggggtactgatggggagtccctcagtagaggcaggggccacctcttctgaccccaagggacccaggccaagaaggagccccctctcccccagggccagggggaccccagcctgccccacactggcactttgcagcaccagggagagaccaggcctcctctgggacaggttccaggcttacgggagctttggtcagaggggcagccacccctgcccactctaagaacgtgaccccagaaaggggcatcatttcttcaacagaagaggaggcgagatgagcttggtgccagttccacggagccacagtgacataaccctccgaacattcgtgaccaaccacggagcacagtgacataaacctccaaacattcatgaccaacctcgattatacagtcacacccagccccgagtggatttaccagagacaggatgttccccaccaggctctcccactaggcagatcctcagcacttggctcaagagtggaacagaccccactagccattgcaggccgttgggcaggcagccctccgacctcagcccatgtgcatatggggtgggggacccgtgggcaaaacttggggtcctaacctgggggggtcaaaccctccacacgcaagtcctggtcagaatcactcagaactgaccctcccctgtgccagcccctcccctgtaccagctcctcccctgtgccagcccctcccctgtaccaagcccctcccctgtaccagctcctcccctgtaccagcccctcccctgtgccagctcctcccctgtgccggcccctcccctgtaccagctcctcccctgtaccagcccctcccctgtaccagcccctcccctgtaccaagcccctcccctgtaccagctcctcccctgtaccagctcctcccctgtaccagcccctcccctgtaccagcccctcccctgtaccacctcctcccctgtgcaaagcccctcccctgtaccagctcctcccctgtaccagctcctcccctgtaccagctcctcccctgtaccagcccctcccctgtaccagcccctcccctgtaccagctcctcccctgtgcaaagcccctccccgtaccagcccctcccctgtaccaagcccctccccagtaccagctcctcccctgtaccagcccctcccctgtaccagctcctcccctgtgcaaagcccctcccctgtcccagctcctcccctgtaccagctcctcccctgtgcaaagcccctcccctgtcccagctcctcccctgtaccagctcctcccctgtgccagcccctcccctgtaccagcccctcccctgtgcaaagcccctcccttgtaccagctcctcccctgtaccagctcctcccctgtaccagctcctcccctgtaccagctcctcccctgtgccagcccctcccctgtaccagctcctcccctgtacaaagcccctcccctgtcccagctcctcccctgtaccagcccccagaccctgaacagcactggccactacacggagccaccaccctggccctggcctgggtgggtgggggtcccccggggagcacagcgcagtgctagggcccctgtagcagattcccaggagacacacacccagctgggcctgctgacactagccctgcattcccacaccccctcccctggccctctcagctgccttgtcctctcctggtcagctgcctggggacactgtcgcgatgcctggcccctgaccttgcccgaagctcctcggtgtctggacattcagcccgacatgctctgaggtttggggcaggtccagcactctgtgggtccaccccatcagccctcagggtgggactcatgcagccacagtttgagagttccaggaaccacaagtcctgagtcagcgggcacctgaccccttatgtcacctgccccaggtggaaggagacgctacagggaccaagcatggttggtaaacgtgtgtgtgtatgtgcactcacgcctgtgtgttaaaatgcttcagagaaagagcagcccaggaacgtgggggttggacgggatgtggaggtgtgggctgtgcctaggggtccctcctggggctgtgtgggtgtgagtggaggactgaggaaaagcctccttacccgggagtgtgtgggggtgctgtttctcgtatactttatttcctgttttaacacatgtgggtgtcctgaaataaaagccgttagccgcccacaagaatgagcaggtttgctggatcacagtcccccacccggtgccaggctgcctgcctgggagactcagggtcctccccaatcctgcctccccacctccacacaagggtgaatctgaagccccaggcacccacgccaggggaactgaggtagagcagacctccagcatccccccgtgacctggcagatggcagtggacattgccctccccagacacccctgtgagttgtcagctctgcctgctggggtggagcccctgacttgggtgagccaagggtgggggggagggtggtgaaccagccggccccccaggtttcctgaaccctttctcagtctcctggaaggggctgaggggcctggcaccttcccaccagagcagtggtccccaacccttttgacaccagggacaggttttgtggaagacacttattctgtgggtgttggagagaagaagggatggtttccctctcagatcatcaggcattagattctcataaggagcggacaacctagatcccttgcgtgcagttcacaataggggtcacgctcctgtgagaagtgaatgccgccgctgatccgagaggaggcggagctcagggtcaggccggtccaccgctcacctcccaccgcgcggccggttcctaacagaccacagcctggggacccctgctccagaggacggggagtgtctctctgtcatccccaacgggccagtgatcccgctggaggggctggggctgcacaggacacaggctcagctgtgctgctggccacccatgacccaatcagaggctcaggtcagagggcaaagatgtccactgaagcggctccagaatccctcaaggaaggtgacatccgcttcgcttcctcctccagccccaccttcgcttccgggaccacagagcccctggagcctgcacgccacggagtctcccactgaggagtgaggaggcctcttgtggggacagatctgggtgagtcaggaggccctgcggggctgggctgggctgggcttaggggctggagcggggagggtttctcagactggagtgggagacttgaggtggagatgtgggttaggtcagggtcaaccctgaaagattgagaatcacacggggctgctcaccttgggcgtgaggagcaaggtctctgggactgactaggtgaagaccggtttcctgggacgggcacgacagggacttgagacccgtcttaggctgtgtcagggcagctgagaaacttgctggcttgtgggtcatggagccccaggagccggtcgaggtgcaggagggggcctgggtggggctgagtcaagggctccggccaagcccctgtggcccaggcggtatttgtttatgcctcatggccgggaggagccactgccttcaccacatcccaccggggtggggcgggtaccaccctctgggacagggaaacttcaagtgggaatttgggcaaatttgaactcagctggattttcagtttgttgttctttgaaggaattcaggactgtgtgccagcgctggccacaccaccaggaggcctggcctggcccgagagggatgccagcttggcatctcccacagggcagggcgtgttgggagccgctgttggctgggggctggcctgagcctgactgcctatgtggagctggcaaggagtgaagaccctgctgccagcacagggccgaggctctccggctaaggacaggcttaggacaggcctaggctctggggtcctcagccccctcccagcagggcccggcccatgctgccagacctgggatgtgcccctggacctccctacctcgggcctctgcccaccccagcctcctcccccagacccctcggtctctgcccctggaggaagccgggagtgtttcttttggaaatgaccccagtttgtggttgttctttgtagacacaccccctgctggggatgagaagtccccctggaccttggtttgggcgggaaaccggctgtgtcccacgttaacctaaatcgtcttttcctctttacgttccagagtcatgcttgaggccaggctcgaatcctgcctgcctttggtggctctgagattcagggctgtcttttctgagagcacccaagtgaggtgccttgggatgcccctgacttggagacacagaggaggctgggcaccccttttccccgacgcactgagccaggtcagcagaggtgctggggcctggcatggcccctgggaaagaacctgctttcctcttgtgggaagtcaaatcctcgcactcagtgccggcaccccttggcgggtgacaagagggcatctcgaaggccactgtgctatgggagttacggctttgactctgagacgggggcctgggtgaggacctggtatcctcaaagtccccgtggctgccctgtggagaagactctgttgggagagggcgctgcctcccagaagtgtcccaaggtccaggaaggaatggggggaagaggacaggagggtgttctcacagtcactgtgacctctggtgagcagagggtccttctcaagctactgaatcctcatggggcttgggtgagggagcgaggataggccaggagccagaggctcaggaggggatggcctcactgtggaaggtgcaggggtggtccagcctgagccctctgccccccgctgcagctcagcaccccccccccacgcacacttacccagggggttgcaaagtgatgggtgttggctctggaactagtcccatgttgtttcccagggaaggagccacacccttctcagacctctgggctgatgcacgaaacggcagccctgcctgggctgcccaccgcccgtcacagaacgatcccgctgcaaatttcacaggcatctggatcgaataacaggctgatagggcgtataaaattagagacagaactctccagaaggcagggtggaggctgcagctccctgggattccacgtgagaaggcagtgatgctgctgcccccacgggaaggacggatgctgagtcagtgggaagacagtgggaagcccagcctggaggggaacgggggacggggtggggggtggtccagaaaaagcagcaggcggttggggtgggacacagggactgtcccgcccggggaggcccccagaccaggagggccagaccctaccgcccctctgcaggaccccatccctgcttcactcccttgctcctagttctgagttgggcccagcctgagtctccaccaggtggacagtagctcctcggggcagctgggtgtgggatctgcaggctcaggcagccacccagatactagcggcctccctgccctccaaaagcccagcctgggatgaaccttgacaaaggccctagaccacagcaaccaccccaccagggctctgagttctccatgaggactggtttccctggaaggtgaacactcaggggctgggacccttaaggattgttcttctcaggtcttcaccgtttccagacgtgtgccttagacatctgcacggacatctcttcccagggatgggcgtctcagggcaggtgcatttaaacttgtgatagagactccaaatcacctctcaaaagcctgttcccattcacacccctgcatacggcatgtcagtggatcccttcctcactggagcaacactagatttagtcataaaatatttttcaatttcttatttctatgattaatagggaggttggatattttgtgatattcattagtttatttgactatgtttctgtttttaccctttaccacttttctagctagtcatttgcttttttcttgttgatttgtgggagttctttatatatgatgaatatcagtactttgtgtttacattgcagatattcgttcccagtctgctgcttattattttacctttttaaggttgttcttttcatcacataaaagtttttaaattttaagtagtcaaatggtttcctttaaggctttggattttgcatttttataccaaaatgctcttgtattttcttccaaactttataattattctttttttttttttttttttgcctttaagttcattttggggcatggggtgagacagaatagcaccatttttccacattaaatcttagatattgtgagccctggaggacacaaattacagcttagaggcctggagcatgattctggagccaggcttcctgggccggagtccacgtcctgcccatggtggctggccattgctttggggagcctctctgagcctcagtgtcctctttgaaagagtggttgttcagagtaagagggtatcttcctgtggacgactcagcttgcgtctcagcccacagtgagcgaagaaccagggggtctcacagagccctgactcaggcgctgagggtccccctaacctccaggcaattcggcctgcacccccacccccgcttcttcttgcctcttctagaagagaggagggtggcggtaaggctggaagggggaagaaaatctgtttcccaaagcctccaggtgattcagccagagtgagaccaaatggcttgggtcttgggttttcagcttcctcacctgtgcggtgcaggtgacagcaccccacttcctactctgtgggcaggtaacacctgcgtgctctgagaaggggaaaacatctccaccctccccagaggcctgcacggccggaggtcacagtgaggcggccacacgccccgggctcttgctccgaggggacgctgtcccaacaagaggccccctcacagtctgtcctgaccctggctctgtggcccctccttctccttgatcaggcccctcccgggtctaccgggatctctggctgccccccgaccccctgctgcagccccaaccctaggtctccacaaagacttcgggatgccccgtgagcccctgggtcctggacccctcttcctcctccagcccctcctctcccagctgctcctggctgccctttaattgctcagagctgttcagcaacctggcgcgtagctggtacataagtggctgttggttggagtcaagtgagtgatggggagatgctaagaagagtgaaagaagcctcggcacccgccgggagcaggtgctgggggtgtgagtgccgctgaatgaacgcgtcctgggacgggatcctgaagcccaccctcccgccgggcccccacaacccagagcgcacaccaaactttctacgtgtctttcccggtcagcctgagcccaaaccacccatgtccctgagcttgtccttgtctgaaagaggagggaagtgtctgtgtcctcaggagcccctggccttaaagataggcaccctggctctggcaggcaggtggcccctggcagcctcgcccacgcccgcggtgactagctctcgggcaagcgatgcaagtgcagaaaccagctctgtgtggtcagtgccccggagctgcagcggcagcagaggtcggaacaccttcctctgtgggcacgccacggaaatttaaagacacagggtgctctttcgcaaaccgggctcgttgattctacaggagaaggtaactattattgagtttcttctttttcagaatgagtggcatccaaacctgactcatatttccaactttattaatttttgcaagacttcggagggtgctctgtggcgattaatattgctgagctgagcacagctgcaatactttcctgtaaaactgactaaaggagaagttggtgtcttcctcatacaagaaatacataaatcagttaaaaatagttctccgagcggatatgatgatgtcgtggccgtcacaggaaacacatgaatcagcctcatcctcagttccagggaagtggggacagtcggtggtccttggacccctcttggggcgcgtgggtgaggcagggtccctctggctttacctcatacccggactggcaaagctgcctgggaggacaactaaaaccatgctcctttgattctgtggacattgctaattgctgggcgttcatttcttgaattcagaccttctcatgaaccagaggagctggctcagaaaaatgccggtgacgcatgggcctgaactggtcagtgcagctcagagatgctcgccgtgggggacgtgcagtttgcctgtgggccagttgtccacccgtcaccgttaccccgctgaggaagctgtgggtgccacccagagagcttgggtacaacacggtctctgctttactcataaaaagccaagacctatgtggtcatggagcgttaaaacagaaatttcacaccacgccgtacggtccccgaggccagggtgttggcacatttcacatccaggaggtgccgtcgctgtcactggctcagcaaagccagtgccgaagccactgcaactgcctgaggcccagcggtggctgggagccaattggtgtcactcggttaccacagggaaggagacgtggctgtagaggcttgtcgcaggtcacagagaagggacttttgggctccaggcctagtgggttcgagtcagcacggtgtcttccccgacaccaaacccaaggaccctcagcacttcctgacctcaggtttctatttctagggtggggagtagaggtgaagggaagcaaagtcagagttgaatataaagctccagaaaaactcagctcagaattgactagagggttgagagcctgagatccctaaggggacatgtcaacccagggcagccgctgagggagattgacatggtttccatggtccttccactgggctggggccctccctggggagtctgtgctgggctggaccttcttccctgccagtggcctctcctggctgggtggggagctccgggggagcagacggcaagagtcttgtttggaaacatgcccttcccaggaaatccccaaaacaaaacctgagaagatctcctggaagctcaaaagcaattttcttttcatatgtcgggccaataagagttaatttcacccagtttctatattttcatgggtccttagaagctttctgaccctgtgccctgagacttagggtctgatggctgaaggaaccttggtcccaggtccctctcctgtggaggggccgtcagagggagagaagagctcgccctggttcacttggcctgtcctgaaagagaaccaggagggagagcagcctagcatgggtgcacacaagcatatgtacaaacatgtgctagggcaactcacacacgtccacatgcatgcacatacacacatgcccacacccatgcacacttatgtgtgcacacagattcagactgtacctgtacacttccacacttccacatgcatgcacatacacacatgcccacacccatgcacacttgtgtgtgcacacacagattcagactgtacctgtacacttacttccacatgcatgcacatacatgtccacgcccatgcacacttgtatgtgcttgcacagattcacacgtgtacatgcacacacacattagcatgtccttgcatatgcacacatacacacatctgacttcacattacatacacacatgtacatgcacatacatgacacacatggctcgaactggaggggagggtcccagttgctcccctcgcctgaccatctagtaagtgttgtgccccatgctgccccatcctgggctcctggccaggctctaagattaactagagaggctctgtccctaagaaaggtcacgcacttcagggtaggtaaggtggacaggcaaggcctggtgacctcggcccatccttgtgcctccagaagccgtaactcacctcaaagaggttttcctgctggagggaactatctctgagcaacaggggcagacttcacagctcaggcgccctcctgaaggtaagaggcactgggctcgcctatcaaagacactctcctgtccccgcaggttcccctatgtcccatcagggagctgggctccaaagtctcccgccctgcttctcctagagaatgcaaaggctgcctctcttccctcccagtgtaacctgaccctcctctgtgccccttggccacccttgcatcctctagctccttctgacaccttctttttgactgttcacagagggcaggatctgaagcctgcagaggtgacccttggtgccttgtgcaaggctggccagcaagtaagcatgacttttggctctgctgccagctgggccatttgatctacacacacttttctgcctctacctggagttaggcgaggctctctatagaatgggtacttgtcaacaaagtgggcttagactccgggcagtagcagttgaggcaggagcagtgggagaagtctgggctaatggcaagcacccagtcccctctgtgagctgcccacttgtcccaggctctgccatggcccttcctctgatttttaggagctttcatgaggcctcgcacagcctgaaggagcagagcttgttgtgctaatccccagcatcctctgcagagttctcaacaccttgtggccgaaaggtccttcagattgtccaggcacccaccccgaaaaccagccctggcatgggggtgctgacccctcccggagcagtggggtgcagggctcataaggcggggtctgcaaagcatgctggggtcttgctctgtgcttactccaaggatgcagcccggagtgccactgctcttggactttccttgaggtgggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcctggctgtttagtttattcttaccagaattggatgtggacagtaccgtcctttacaaatgattcttatcaagtacataatgtgttcagtagcaattcttttcaacttctgttaaacttaatccacaagaggaatggtgggttctggtcactactaacagcaataaaacaaaaggactgccagactgcccaaaggaatctacaaagggaccttttctggtgaattcaattttatggaataattgtaatgccattattggcgggattgctccagccagaatacgacatgctcagagttcaattatttgttacaatattagaggacggatggcagtcctacaggttgagagaatgggtgtctccttacccattcaaatggatgaacacaggcattgttccttctagaccaaaaatgattcatcccattgttaccccagaacatcctgaattatggaaattagctgcagctatgacaggaataaggatatggagtgctacctatcaactctctcccactaatatcaaaacacccacattcaacatcaccttgatgtctgaacaggtgatacgtatcaggagctgtgtcaaacccccttacatgctgttggttggaaatataattatcattcccaatacacaaaatatagaatgtgataattgtaagctgttcatgtgcattgatgctacttttaatcccacaacaagtattctattcgtaagggctagggagggggtatggataccagtttctttacatcatccatgggagtcttccccctctatacacatagtcaatgaagttcttaaaggtatcctgaaaagaacaaagtgatttatttttactgttattgtagtcattgcaggtctaattgcggtttctgcaacagcggcaaccgctggagttgagatccacagttctgttcaaaccactcaatatgttgaagcatggcaaaaaaactcctccagactttggaattctcagactcaaattgatcaaaagttagctaatcaaattaattatctccaccaaagtgtaatatggctgggagatacagttatgaatttggaacaccgtatgcaattacaatgtgattggaatacttctgattactgtataacaccttatgcttataataaagatcagcatagctgggaaacggtctcaagacatttaaaaacctgggatgataaccttggatatttcaaaacttaaagaacaaatttttgaggcttcacaggctcatttatccactgttctgggctcagacatttttgaaggaatagctaaagaattatctgatcttaatccctttaaatggatcaaacccctcagaggatcattgttgtcactggcattattaatattggtatgcttatgttgtctacttttagtctgcagatcccgcaaggaatccgaagacaagtccaaagtcaacgacaagcaatgatggcaatggtgatcctagttaataaaaagcggggagatgtgggtggcaagccacccaggtgccgaggcaagagaccgagagcacgagctgttccagtgtaataaaatatataaaataacaagagttatactgatatagctcatagatatgattatatataaataccattaatcattagtttgtagtaattactctttattcaaatattataataatcctcactctacaatcataacctagaaaaaggcaggccatgcagagataggagctgaggggacatggtgagaagtgacaagaagacaagagtgtgagccttttgttatgcccaggcagggccaccagagggctccttggtctagcagtaatgccagcgtctgggaagatgcccgtaccaagcggaccatggtctagtggtagcgtcagtgccaaggaaaagcacctgctactgagcagaccaggaaagggagtctccctttccccaggggagtttagagaagactctactccaccatctcttatggagggcctgacataagtcaggcctgcctgcagttatccagaggcctgaccgtctccctgtgatgctgtgcttcagtagtcatgctcctggtctgctttcatgttccatcctgtacacctggctctgccttctagatagcaatagcagaattactgaaagtattaaaagtctctgaaatgcagaaataatggtgtaagctgtctctcctctctctccgcctcggctgccaaacagggaagggctccctttccagtggatgcatgacccacgtgaccttacctatcattggagatggctaacactccttaccctgcccccttgtcttgtatccaataaataacagcgcagcctggaatttggggccactactggtctccacgtcttggtggtagtggtcccccagccccagctgtcttttcttttatctctttgtcttttgtctttgtttctatgatctcttgtctccgcacacggggagaaaaacccacagaccctgtagggctggcccctacaggctctcaactgtgtctctgttcagccctgctgtagggctctcaaccttctgcctgtttggcctggcaatgaggccctcaaccctatccctccacagcctggttatccatctctcacttctgcttctcctttggtgcatcaggctccctcgaagcctgtcctgcagttactgcagcagccttgatttctcaaccctaaaagacctgcccagcaggtaatcgcacctcatcctggcttacaggttcttgattcttcctctatccaaaactcgaatctctttttggcttctggtccggttaccactgctgttgccaccaccatggctgctcataagcaacaggttacatacattcctgaaaatgacactcctcttatgagagccatttctcaagccagggagtatgggcatcctgaggcctagcaacttcctcttattctacatccccatatacctgccgctcctgttgctgtggcacaggatcagccacagcccgctgatcctgctcagcaggtggctgatcacacggctccccaaggtccgcagcctgaaaatcaggctcctcaggcaaataatcaggctcctcaacctataccataaatgcttgctgctgtagcgcagccagctccaggtatacctgcagtccaggcagtagtccaaccagatccttttcatccaggccaggtccagttactccctgctacacgggaaagtttttcttttaaattcctcaaagatttcaaagaatcagtgaaacaatacggcaccaactccccttttgtgcattccacattaaaagctctagcagaggataaacgtttggtgccttatgactggggaattctagcaaaatcagtattatctgaatcccaatatttataattcaggacttggtgggttgatgctgtccacgatcgagttcagcttaatcaaggctctaatcctcctgttaatattacagctgaccagttattgggaatgggacaatggcctgcaattacaaatcaaactatactaaatgatgaggtcattcaacagcttcgcaaatgctgcctatatactaatagtagtgcatttataccagtccctaacgatgacaggtttcccgctcaaccagaggaagaaggtatgcagtttaatttgtcaattggatataaatacccgccattgtgcataggaatgtcacctggctgcttagctttctctaatcaaaattggatatggactgtaccgtcctctaataatgattcttatcaagtacataatgagtttagtagtaattcttttcagatcatgactgttaaacttaatcctcatgaggaatggagagttcccgtcactaccaaacataatacaacaaaaggactgctagactgttcaagtgaacctaccagggaaccttttacagttgaaactattgtatggaatgattgtaatgctccaaaagcagtagtgttacagcgcctgattacaggtggttattgactgggcttcaagaggatattattggctaaatttttccagcctaaatgccaaatattctgagttcaactatttgatagattatgtagaggagggatggcagtcctacaggctgagggaatgggtgtctccttacccattcaaatggatggacaaagtgatcattcctcctagaccaaaagtgattcatcctattgttaccccagaacatcctgaattgtggaaattggctgctgccatgactggaattaggatatggaatgtaacctatcagatcactcccactaataccaagacagacgtatacaaagtcaccttgatgtctgaacaggtgatacctagcaggagctgtgtaaaatccccttatatgctattagtcggaaatataattatcaccccccaacagccaaaccatagaatttgatgattgcaaattgtttacatgtattcgtgttacatttcatcccataacaagtattctcctggtaagggctagggagggggtaaggataccgtttctttacaccacccttgggagtcttctccctctattcatatagtcaatgaaatccttaaaggaatccttaagagaacgaagagattcatctttactcttattgcagtcattgcaggattaattgctgtcactgccacagcaatggcagctggagttgctatccacaactctgttcagaccactcaatatgtggaagtgtggcaaaaaaacaaacaaacaaacaaaaactccaccagactctggaattctcaggctcaagttgatcaaatttggctaatcaaattaatgatctccaccagagtgtgatatggctgggagatagagttatgaatttgcaacaccgtatgcaattacaatgtgattggaataattctgattattgcataatgccttatgcttataaaaaagatcagcatagctgggaaaaagtcatgagacattcaaagcctgggatgataatctaacttaagatatttcaaaactgaaagagcaaattttgggggcctcacaggctcacttaactaccgttcctggctctcatatttttgaggaaatcaccaaagtattatccgatcttaatctttttaaacggatcaaaccccttagaggttcactattgtcactagcattactgatattggtgtgtttatgttgtctgcttttagtatgcagatgtcttcagggagtccgatgaaaagcccaaagtcaacaacaagcaatgatggcaatgatgatcctagtcaataaaaagaggggagatttgggcagctgtggacgaaggattacccaggtgccaagacaggagactgaaggcacaaactgtagcagtataataaagaaaatagttagaataaagaatacttacaatacaaattagatatagagatgatcatggacaattatcaatcaataatgtataaacattattaatcattagcttttaatattagtctttgttgcattactaatataacctaggaataattgatgggtgtaggatcatgtactgaagggacattgtgagaagtgacctagaaagcaagaggtgagccctctgtcatgcccacataagggccggttgagggctccttggccaagcagtaatgccagtgcctgggaaggcacccgttacttagcagaccaagaaagggagtctccctgttcttggaggagtcaggaaacactctgcttcaccacctccttgtgggaggctttatattatccaggcctgccctgcagtcatctggaggcctaaacccctccccgtggtgctgtgcttcagtggtcatgctccttgtccactttcatgttcctcctgtactcctggttcctctttgaagttcatagtagatagtggtagaagaaatagtgaaagtcttaaaatctttgaactttcttataagtgcctagaagaaaacactgatgtatgctgcctttcctctctgcttcagctacctaaaagggaagggccccctgtcccatgatcatgtgacttgcttgagcttatcaatcacttggacgtctcaccctccttactctgccccctttgtcttgtatgtaataaatatcagcgagcccagccattccgggcccctactggtctctgcgtcttggtggtaatggtcccctgggcccagctgttttctctttatctctttgtcttgtgtctttatctcttataatctctcatctccatacatgggtagaacacccactaaaccctgtagggctggaccctacaggcggcaagctacccaggtgctgaggcaagagaccgaaggcacaagatgttccagtataataaaatatatagaataagaatagttatactagaaatagaatacagatatgatcatatatgaatattaatcattagtttgtagatttactctttattccaatattataataatatctgttttacaattataacctagaaaaaattaggccatacagagataggagctgaaaggacacggtgagaagtgaccggaagacaagagtgtgagccctctgtcatgcccggacagggccactagagggctccttggtctagcggtaacgccagtgcctggggaggcacccgttacttagcagactggtctagtggtagcgccagtgcctgggaaggcacccgttacttagcagaccaggaaagggagagagttagagaagactctgctccacgacctcttgtggaagatctttgtcaggcccacccgcagccatgcccacagccatctggaggcctaaacgtctccctgtgatgctgtgcttcagtggtcacgctccttgttcattttcatgttccactctgtgcacctagcctggccttctagacagcggtagcagaattagtgaaagtattaaagtctttgatctttccgagaaatgcatagaagaaataatgacgtaagctgtcccctctctgtctccacctcagctaccaaatagggaagggcccctgtccagtggtcacgtgactcacgtgaccttacctatcattggagatgacctgcactccttaccctgcccccttgccttgtatacaataagtaacagcacagccaggcattcggggccactaccggtctccgcgtcttggtggtagtgttcacccgggcccagctgtcttttattctatctctttgttttgtgtctttatttctatgatctatcatctccacacacaagagaaaaccccaaaggccctgtagggttggaccctacatctggcgcccaacgagaatttctctctcgctgtgtgaagttgcactttgagcgtgaaacacagcagaggatttcaatgacagattcctgaggattgaggtcaataagcttggtggtaagcttgggcactcagagtatcccagggacaccaagggacaggcctgtactaagtactcagcttatttaaattttataaaaactctccttaaagaaggagtggttaaaagtatctactgataagttaattgaactgtttgatgttgtagatcttctttgcccttggtttcctactgagggaactttagaacttaaggattgggatgagattggcagacattcaaaattgctcataaaggcgggcatattattccacccccaatttggtcaatctgggcttcggttcgctctgtcctagactctttacagactcaggaggacaacatggagactgatccctctttcctctgaggaggctgaggaagtgcttagttctttttcacctgaggatactgcacagattgaggccatagttctacagatggacctccactctgatattcctttggtgccaccacctacgccagagcctaccatgccccagttatcgctttatgatgaacttttaactgatctgaatgaatttatttcccccaaccagcaaaatccagctgaaagatattatcaacagccatcacagctgtaccctcctacctttcctcaaactctcaactctccagctatgcagatagaaaatgagatgatgcagcctgaaaaagaggctctaaactatgttttcatgcagcctggtacagaggctccaatttctacacagcccggtgaagaggctctcaattccctgcctggtaatgaggccctgaaccctatccctgttcagccctgctgtagagctctcaacttcttgcctattcagcctggtaatgaggccctcaaccctatctctgttcagccccgctgtggggctctcaactttctaccagttcagcccagttatgaggccctcaaccctatccatattcaacctatttttccacctctctcttctcgttctcttttgacaagtcagtctcccttgaagcctggacctctcttggtaaatcaggctcccttgaagcctgggtctctttcagaaatcaggctcctttgaagcctgggtatcttttggcaaatcagtctccctcgaagcctgggtctctttcggcaaatcacacttccttgaagcctgggtcttttctgacaaatcaggctcccttgaaacctcaggctctcttgaagcctggtccacagttactgcggcagcctcaggcccatgaaagacctgcccagcaggtaatctcgtctcatcctggcctacaggttctcaactcttcctccattcaaaattccaacctttttcctgcttctggtccagttgctactgtggtggccaataccaccattgccgctcataagcaatgagctatatacatccctgaaaatgacactccttttatgagggctatagctcagacaagagaatatggggatcccgaagcctggcaatttcctgtaattttacaacctccaatacccgccgtcccagtggcacaaaatcagccacagcctgctgatccttctcagcaggcggctgatcccgcaacccgtcaagatcaacagcctgacaatcaggctgctcaggaaaataatcaggctccacaactgcctgccgctgagacacagccagttcctgatgttccagtagttcaggcagtagttcaacctgaccctatacatccaggccaggttcagctatgtcccgctacttaggaaagtttttttttcttttctttctttttttttttttttgagatggagtctcgctctgtctcccaggcatgcccggctaatttttttttttttttttttttttttttttttgtatttttagtagagacagactttcaccctgttagccaggatggtctcgatctcctgaccttgtgatccacctgcctgggcctcccaaagtgctgggattacaggagtgagccaccgcacctggccaagtttttcttttaaattcctcaaagatttcaaagaatctgtgaagcagtatggcaccaactccccttttgtccattccaaattaaaagccctagcagaaaataaacacttggtgccctatgactgggagattttagcagtcagtcttatctaaatcccaatatttacaattcaggacttggtgggttgatgctatccaggaatgcattcgtctttgggctctaatcctcctgttaatgttacagccgaccaattactgggaatgggccagtgggctgcaattcgaaaccaaactatactaaatgatgaggttattgaacaactgtggaaatgctgcttagatgcttgggacaagattcaagatgatgacaaactatgcccatgttttacagccgtcagacggggacaacatgaaccgtatccagactttattgcccatcttcaagacgcagcagaaaaagctatccctgatagccagggccaatgacttgttatagaacttatggcttatgaacaagtaaatccagactgtcaggtggctatttgccccattaaaggcaaaattccaccagggggtgatgtactcacctcatacattaaagtctgtgaaggcgtgaggggaactctgcgtacagcaatggtcatggcacaagccatggtctctattcgaatgcctggacaattccctggcaaatgcttcctatgcagccaatcgggatattctaaaagaaattgtccttggcatacaggccgctgttcttttcaacaccaacaaccaaaattttttcaacaacaagccccactttctactatatgcccacgatgccaaaaaggaaatcactgggtggctcaatgccattcaaaatttgatattgatggcaatcccttacggtcacttccaggtaaacgggaagaggggccagccctaggcccctccaaacaatggggcattcctcaactctgagcccctggcgtccagcaagatgagcgccttgccagcccaatccattcaacgtacatcccaattcccacttcagcaatttgtgccacaggatctaatggctctgccccaacacgaatctcagtacaatgcttgtcccctgccaccacaggctcagcatcagtagatctctgttgtaccagagatatttctctgttacctggagagccacctattgctgttcccacaggtgtttttggccccttgccgactggcagtgtcggtttgctatttgatctctcaagcctaaatttaaaaggtgttcaagtacatactggtgtaattgattctgactattcaggtgaaattcatattgtcattagctctgcagtcccttgatatacggcagctggagaccgcattgctcagcttcttatactcccttacgttcctttaggatccagttcttgtaccagaactggaggttttggtagcacagactatcaggacaaagcagcttattgagccagcaagatttctgacactcgtcctgtgtgctctgtgcatattcaaggaaggaagtttgagggaatgattgatacgggcgctgatgtctccattatcgctttacatcaatggccccgacactggccaaaggaacacgcgtccacagcattagttggtgttggtcaggcttcagaagtctatgaaagttctacaattttacactgtacgggcccagaagaacagattggtactatttgccccctcattacacccattcctgttaacctgtggggaagagaacttttacaacaacgaggggcacagatttcttttccacaaggcaattacagccagcaaagtaaagacattatgacaaaaatgggatttgttcaagttatgggcttagggaaatcagcacaaggcatcaccgagcctattatacctacccataaatcagattttacgggacttggttattctttttagaagtggtcactatcaagcctccaaatcccatccccttgacttggaaaactcagaaaccggtttgggtaaatcagtggccgctccctaaaaataagctggaggcactccatattttgatccttgaacagttaaaattgggacacatcgagcaatctttttctatctggaattcacctgtctttgttatccaaaagaaatccggtaagtggagaatgcttactgatcttagggcagtaagtgctgtccttcagcctatggggacattacaacccagcttgcctttccccgctatgattcccaagtattggcctcttatcatcattgatcttaaagactgcttcttcaacattcctctggcccctcaggactttgaaaaatttgctttcacagttccaacccttaacaacatcgctcccacagcacgttaccattggaaagtcctacctcagggaatgcttaatagcctaccatttgtcaatattacgtggggagcatattaaagccagtaagagatcaatttccccaattttttatcattcattacatggatgatattctttgtgcagtgccttcacgttctgtattaatatcttgtttctctgcagtacgacaagcagttgcaacagctggtttggctgtcgctccagaaaaaatccaaacttcttctccttatcaatatttaggaatgcagctagaagacaaggttattaagccccaaaaggttcaactcagatgagactctctaaaaacgctaaatgatttccaaaaaatgcttggagatattaattggatttgcccctccttaggcattcttacatatgctatgtctaatctgtttgcaacattatggggcaatcctgatttatgcaacaaaaggtctttgacccctgaggcagattctgaattacaacttatagaaaaacgcattcaacagtctcaggtaaccagggcgaatccatatttaccttttgaaatactaatctttcctactaaacattcaccaacaggactcattatccagggacataatttaattgaatagtgctttcttccacacagctctttacggacgcttaccgtttatctagatcaaatttctatcctaattggtcaagctctttctcaccttcttcatcttttgggtacagagccccaaaaaatcattgtttccctcacctgattacaagtccaacaggcttttgcaacctgcattgcttgccaagtacatttggcaggtttcctgggtataattgacaatcattatcctaatgtaaaactatttcagttccttaaacttacttcttggatcttacctaacattactatggatactccattagctgaagctgtcactgtttttactgatgcttcctgtaatgaccaaggagcatatgcagggccaaaagaatgtgtccttaactcaggagctacttcagcacaacaagctgagctgactgctgtcatggctgttcttgaatatttccctgaaccagttaacatagtttctgatttggtgtacgcagcaggtgttgcttgcaacattgaaactgccttaaacacatttctgcctgatgataaccactttttcttttccaaaagtttcagtccctactcagagcaaggtcttctcccttctacattactcacgttcgggctcacatgcccctccccgacctctctcagcagcaaatgccagcgctgatacattagttgctcccatttttatggacgtagaaaattttcacgctgtaactcaagtcaatgctgcgggactcggaaaaaagttctgcttcacatggaagcaagctaaaaccattgtatgtcactgtcctacttgccaagtgttaattttacatccactttcttcaggagttaaccctagaggactttcacaaaatattctctggcaaatggacgtgactcattatccagctttcagcaaactctcttttatgcatgtaactattgacactttttctcattttatctgggccacatgtcaaacgggggaaagtacggctcatgttaaacagcacatggtttcatgtttcttggttatgggatgtcctgagaaactaaaaactgacaattttctggttacattagcaatgattttaaaaagttcactcagacatggggaattactcacacaactggcattccctataactgtcaaggacaggcattggtagaacgagttaataaaatgctgaaagaccaactttgaaaacaggacactaaagagaagaaggatgctcctacccccatactcagttaaattttgttctttttacactcaatttcttaaacctagcaagaaatcaaccttttacagcagcagaacaacatttcactggaaacagatttgatccacaaaaaggaaagtgggtatggtggaaggatacaaaaactgacaaataggaattaggcactgtggtaacatggggtaggggtttcgcttgtgtttccccaggagaaggacaacaacccgtgtgggttccctcccatcaactgagattgcattttaactccaaggatgaagaactctcagaaacaaaaggcaaagaagcctcagaaatcaaagagcaagttttgccacctgacacataaattccatgacctcgacattacaacaaaatctcaccgtgtgacctccaacacaagtcattctactctaccaacatggggccagataaaggtcttatcccatcaaacagagaaataactacaagaaaaaggaattccaaaagtgacgggtaatataattctggctgcctttatggtggtcagtgcagtggtgagtataccaggggttggggcaactcaaaattatacctactgggcatacattacttttccccctttaattcggtctgtctcctggatggactcctcagtggaagtttacactaataatagtgtcttcatgccagtccccaatgatgacaggtttccagctcaaccagaagtaaaaggtatgcactttaatttgtcaattggctacaaatatccaccactgtgtattggaatgttgcctggctgcttagcttattcttatcagaattcgatgtggaccatacagtcctctagtaatgattcttatcaagtgcaggagcaattcttttcaactcatgaatgttaaacttaatccacatgaggaatggagagttcctgtcactactaaaagcaataaaacaaaaggattgccagactgctcaaaggaacctacaaagggacattttctactaaattcaattttatggaatgattgtaatgctccaaaggccgtagtgttccaaaatctagctatgggtgctgttattgactgggccccaagagggtattattggagaaattgctctggctaaaataccaaatgcttggagtttaattatttgttagattatgtaaaggactgatggcaattctacaggttgagggaatgggtgccccttatccattcaaatggaggaacacaggaatcgttcctcctagaccaaaaatgattcatcaaattgttacccctgaacatcctgaattagggaaattagctgcagccatgacaggaataaggatatggaacgctacctatcaaatctctcctactaataccaagacactcatattcaagatcaccttgatgtcaggacaggtgatacatatcaggagctgtgtcaaatccccttacatgctgctagttggaattataattattactcccaatacacaaactatagaatgtaatgattgtaacctgttcacgtgtatcgatgctacttttaatcccagaacaagtattcttttgataagggctaggaagggggtatggatataatttctttacatcatccatggaagtcttccccctctatacacatagtcagtgaacttcttaagggtatcctcaaaagaaccaagagattcatttttactcttattgcagtcattgcaggactaattgccattactgcaacagcgacaaccgttggagttgctatccacaactctgttcaaaccgctcaatatgtggaagcatggcaaaaaaaactccaccaaactctgaaattctcatgctcaagttgatcaaaaattggctaatcaaattaattatctccaccagagtgtaatctgactgggagatagagttatgaatctggaacaccatatgcaattacagtgcgattggaatacttctgattattgcataagaccttatgtttataataaagatcaacatagtggggaagaagtctcaagacatttaaaagcctgggatgataacttaaccttagatatttcaaaacctaaagaacacgtttttgaggcctcacaggctcatttaactactgctcctgccttgggcagttttgaaggaataactaaaggattatctgatcttaatccctttaaatggatcaaacccctcggaggatcatcgttgtcattggcattattaatactggtatgtttatgttgtctacttttagtctgcagatgtctccaaggaggccgaggacaagtcccaagtcaacgacaagcaatgatggcaatgatgatcctagtcaataaaaagtggggagatgtgggtggtaagccaccgacgtgccaaggcaagagacggagagcacgagctgttccagtataataaagaaaatatttagaataagaatagtcatactagaaatagaatatagataggattatatgtgattatatgtgaatattattaatcagtttgtaacattactctttattccaatataataatctctgttctacaattataacctaggaaaatctaggccatacagagataggagctgaaggaacatggtgagaagtgaccagaagacaagagtgtgagccctctgtcatgcccgggcagggccactaggagggctccttggtgaagcggtaacgccagtgtctgggaaggcatccgttacttagcagaccaggaaagggactctgcctttccctgcggagtaagagaagactctgctccaccacctcttgtggaaggcctgacattagtcagacccgcctgcaaccatgcctgcagacatccggaggcctaaacgtctccctgtgatgctgtgcttcagtggtcctggtccactttcattttccgctctgtgcacatggccccgccttctggatagcagcagcacaattagtgaaagtattagagtctttgatcttcccaagaaatgcaaagaagaaataatgacgtaagctctcccctctctgtctctgcctcggctaccaaacagggaagggccccctgtacagtggatgcatgactcgcgtgcccttacctatcattggacatgactcgcactccttaccctgtccccttgccttgtatacaataaataacagcgtagctaggccttcagggccactaccggtctccgagttttcgtggtagtgttcccgtgggcccagctgtcttttctactatctctttgtccggtgtttttatttccatgatctattgcctccgcacacaaacagaaaaacccacaggccctgtagggctgcaccctacagaaagccatccagatgccaaggcaagacactgaacgcagaagctgttcaaatataataaagaaaataggataaaagaaagttatatcagacataggatacagagatgattacatatggatattatcaattattagtttttagtattaatctttgttattataaccgaggaaaaaacaggccatacagagtaagaagtagaggggacaatgtgagaggtaaccagaagacaagagtatgagccccctgtcatgcccggataacggctgcttgagggctccatggtcttgtggtagtgcctcttcctcggaaggcacctgttatttagaaaactttggtctagcggtaatgccagtgcctgggaaggccctggttacttagcaggccttggtctagcggtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtacacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactccgggccactacctgtctgtctccgcgctttggtggcagtggtcccccgggcccagctgtctttcttcctatctctttgtcttctgtctttatctcttcgatctctcgtctccgcacacacacgaagagaaaacccacagacccggtaggggtggaccctacattatctcagctacaacataatcaagatattcacgtggactactgagtctttcggtgcccccttgctgttttagttttgtcctgcggccgagtgtttccctcgcttcacgccaacccaatctccgccgccctgtcttgtcatccccattctacagcccagcacggtgtagtatggcagccgctagccacaggtatctagggagccctggaaatgtggtcagttctaatggagctgcgctgttaagtgtgaaatacacatgggattttgacggcagtgggagcaaaattctcccaatttttttttttttttttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttggtcaggctggtctccaactcccgacctccggtgatctgcccagctgccgcctcccaaagtgttgcttgcgattacaggcttgagccaccgctcaccctggctttttttttttttttttttttttttttttttttttcagacaaactctcgctctgtcgcccaggctggagtgcagtggcgcgatctcggctcactgcagcctctacctcccgggttccagcgattctcctgcctcagcctcctgggtagctgggattacaggcgcaggccaccacgcccggctaatttttgtatttttagggggtttcgccatgtcggccaggctggtctcgagctcctgacctcaggcgatccgcccgcctcggcctcccaaagcgctgggattacaggcgtaagccaccgcgccgggctctttcattctgtctttattttctgagatagagtctcgctcggacgctcaggttggactgcaacggcgtgatctcggctcgctgaaacttccgcctcccgggttcaagcgattctcctgtctcagcctcccgagtagctgggattattgacgggcagcaccacgcccggctactttttgtggtttttgtatgttctgtcttctgctctttagtaccgcatagagccgcagaagactagcgagtcgaacaaacggcccctcttgcagcagttgttgatcacggggctgccccccggtactcatcctgtgtctctcgtccaaatccccgctcctcctcagctatcacctctgccgatgctagtggtttccctgggtaccgggaaccaaactctcattccccaggggcctaagccccccgtggccaggcccttctcaagtcagggttcctgcacattcacagttacgggtggccctgggagtaacacctggcacccaaacaggtcaccagagtccacacatagtccacctgccctccctgcgtaagatcagctcttcctcctcccgacgatagatcagggtcaatgatccctgccaagatggcgactgctccagcctgctggtccaacctgtccagccacagctgttgctcgaaggcttgaagttcaatgggaccctctcccgctttctacaaactggttcctttatttttatgtttatttatttgggacggggtctggctctgtcacccaggctggagtgcagtggtgcaatcactgctcactgcagcatccacctcccagcgtccacccatcctcctggcctcagcctccggaacagctggggtacaggtacgccccagcccgaacaggttttcactaggttgcctgggctctttctttctttgtctgtgtttgtttgttggttggttggttggtttttgtttgtttgtttcgagacggggctccggctctgccgccgggggctgcagtgcaatggcgcgatctcacctcactgcggccttctgggctcaagcgatcctcccactgtgcccggcctgaagacagcctttagagaaagaagcagggggagttcttccgaggacagacaagatttctggagtttggaaagggtgagagactgggtcagcgaaaggaacattccggtctttatgttgggatgcaacgtatagatacagggatgagacccaaaagagccggcagaggtttgtcatcgtgctcgcaaggcaactgccggtggctgatcccgtaaaggatacacatacctagagcggagcctaaagatgcatccagcatgacgggtggagccacgatgcttggactcgagctctgctcctgtgcgttccgtgatcaatggcttatactacctgcacctcagtttttcccgggcaaaaaaggaagcttgctgccggtgcgttggcacctgccttaaagtgccagctactcagcgggctgaagaggaagaagttcctactaggaagacacgtggacacgtatgtttactgcagcactatttacaatagcaaagacttggaaccaactcgaatgcccatgaatgataggctggataaagaaagtgtggcacgtatacagcatggaattactacgcagccataaaaaaggatgagttcatgacctctgcgggaacgtggatgaagctggaaggcctcattctcagcaaactgacacaggaagcgaaaaccaaacaccgcatgttctcgctcctaagtgggagttgaacagcgagaacacatgggacacagggaggggaacatcacacgccgggccctgacggggcgtggggggcaaggggagagagagcattaggacaaatagccaacgcatgcggggcttcaaacctagacgactggtggataggtgcagcaaagcaccgtggcacacgtgtacctatgttccaaacctgcacgtcctgcacatgtaccccagaacttgggagggggtgggggaaaccaaaagagagagcgagggagaggcggggagggggggggaaagagagagagagacagagagaggagagagagagagagagagagagagacagagagacagagacagacacagagagacggagagacagagagagagagagaaagagagagagagagagagagagagagagagagagagacaggagaaagaagaactccgggtgggtcccattcctttaaaaggtcgccacccactcgactgccaagctgagatcctaaggacctccccaaaggaggaggtcgtggccttcccaaagcgcagtagccacggtggaaacgaaagcgtgccgcataagcctaccgtctaccgcccgcacatcaggaacctcacggtacttcagggaagcagttaagtcaagccggcgcgtcacaggcactcggcgtgcaagccgccccgcaggtgctaccgtctctcacctccctctacttttaggaaacacgttgtatccccggagggggtgcaccgttcctggaggtactgcaacaccaggtcgatgcgtggagtggacggagcaagctcctattccatctccctgctccaaaaatccatttaatatattgtcctcggatagaggacgtatcagatattaaactgataagaacagatactacacttgatcttagccgaaaggccgagaagcgatgcgctcgccttcgcgcccgccgtcaccgtcccactctcatccacattcaagtcgcggtgagagccccagcctcgctccttgccccattccctctgtctcgtccacagcgctattgacgcccttacactctcgggctgatttcttattctccgcctttgaaaagggaaatcttacacccgtgcttcttccggcgttcccgggctttcatttcgaatttgcatgccccgccctttcacagagggcgtggcctccgccgttgactccgcccccggggccgcctctgcctgggggagccggggctccgctgggggcgacttccttgttcgtatcgagccagcgaaaagacagaaccggaagagaccgggggcgaaggcgacaggggtctgtggaagagacctgtcggcggagagcggtccacgttttcctggagaaagacgaggccccagggcaggagcgcgggctgcgctgggcctttacttcgccgcccgcgggcggggagaccggccccgtacccgaggggacgaggggacgaggggcccatgcccagtcagggaagccgaaggcctggaggggcttccgggagcaggggctggagttcctctgccaggcaggaggctggcaccagacacccggcagagggaggcggcgagggcccagcaaggattctccccagcccctgtgcctgcgtctcctgcggcttctgtgcgcggaccgtgtcctgggctgtgtagggaacgctgcctctctgctcgggacgtggattcctttcccctcctcctcgcctggctacttctgacgcaggtcgtcaggactccgcttgggtgtcacccgtgcaggaagcctcccttagtcaagggccctcggcacccgccccatatgtgactagcagccctcctgtgtatttcatcgcgcccccgttgtttatatcagctattccactcaccacccttctgggcaaccctttatctcccgctctgaaatcccatcgctgagggctgggacccctcctcagtgcttatccctgtttccccgcgcgagtctggcgcctggcgtgtggaaggcgctcagtaaacgtttgtggagcgaagaaacgacgcaaaggtgatgagcacgacgcagttaggaggctattggcccggcgcgggggaaaagggggaaggtcgggctcggggtggcaggaccccagagggcaggggtgactgccggggtgctcttggggcaaggtgggcgtcaaggcccccagcaaggttgggataaagtttctctccgaggcacagactgccgcctgcgggctcagcatttacctctcccttcctccttcctaacgcaacttcagcggagggctgagggctctactgcgcattacctggaaaacttatttcactccacggccctaagaggtgggccttattattagccacggccagggttagggtgaggccactcctccagggcagaatttcagggggtgcccacccccccgccctaaatcattcagcaatcaacataaattatagttcaacgcaatatatcttatcttgtgggccgcaagccacccaggtgcccaggcaagagcctgaaggcacaagctgttccagtacagcaaagaaaataattagaataagaaaagttttactagagataggaaacggataggattatatctgaccattattaatcattagtttgtagcatcactctttgttctattaccataatgatctctgttctattatgattaccttgggggaaaccaggccacacagagttaggagctgaagggccacagtgagaggtgaccagaagacgagagtgtgagccctcattcacgcccagagaagggccgctggagggctccttggcctagcggtaatgccagtgcctgggaaggccctggttacttagcaggccttggtctagcggtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtgcacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtcctgcggccgagtgtttccctcgcttcacgccaacacaatctccgccgccctgtcttgtcatccccattctacagcccagcacggtgtagtatggcagccgctagccacaggtatccagggagccctggaaatgtggtcagttctaatggagctgtgctgtaagtgtgaaatacacatgggattttgacggcagtgggagcaaaattctcccaattctttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttggtcaggctggtctccaactcccgacctccggtgatctgcccagctgccgcctcccaaagtgttgcttgcgattacaggcttgagccaccgctcaccctggcttttttttttttttttttttttttttttttcagacaaactctcgctctgtcgcccaggctggagtgcagtggcgcgatctcggctcactgcagcctctacctcccgggttccagcgattctcctgcctcagcctcctgggtagctgggattacaggcgcaggccaccacgcccggctaatttttgtatttttagggggtttcgccatgtcggccaggctggtctcgagctcctgacctcaggcgatccgcccgcctcggcctcccaaagcgctgggattacaggcgtaagccaccgcgccgggctctttcattctgtctttattttctgagatagagtctcgctcggacgctcaggttggactgcaacggcgtgatctcggctcgctgaaacttccgcctcccgggttcaagcgattctcctgtctcagcctcccgagtagctgggattattgacgggcagcaccacgcccggctactttttgtggtttttgtatgttctgtcttctgctctttagtaccgcatagagccgcagaagactagcgagtcgaacaaacggcccctcttgcagcagttgttgatcacggggctgccccccggtactcatcctgtgtctctcgtccaaatccccgctcctcctcagctatcacctctgccgatgctggtggtttccctgggtaccgggaaccaaactctcattccccaggggcctaagccccccgtggccaggcccttctcaagtcagggttcctgcacattcacagttacgggtggccctgggagtaacacctggcacccaaacaggtcaccagagtccacacatagtccacctgccctccctgcgtaagataagctcttcctcctcccgacgatagatcagggtcaatgatccctgccaagatggcgactgctccagcctgctggtccaacctgtccagccacagctgttgctcgaaggcttgaagttcaatgggaccctctcccgctttctacaaactggttcctttatttttatgtttatttatttgggacggggtctggctctgtcacccaggctggagtgcagtggtgcaatcactgctcactgcagcatccacctcccagcgtccacccatcctcctggcctcagcctccggaacagctggggtacaggtacgtccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggattcggcctttggctacatcagtgtaatgtctgttcttgtagtttctctgacatgcccggcctcccgagggatgtcgccgagcactcgctggatattcgggccggagcccgacccgacctggatcctctgcgccgattcgacgaggagaagcgcagagcgatagcgcgaggagatccaccagctaatggcagccgggttcatcaaagaggtattccatccgcgaatggcttgccaaccctgtgcttgtgatagagaaacgggggaaatggtggatgtgtgtagactacactggtctcaacaaagcatgtccgaaggttccctaccctctgcctcacagcgagctaatcgtggattccactgctgggtgcgagaccctggctttcctcgacgcctactcggggtaccaccaaatcaggatgagagagtccgaccagctcgcgacttctttcatcacgcccttcggcatgtactgctatgtcaccatgccgctcggtttgaggaatgtgggcgcgacgtaccagcggtgcatgaaccatgtgttcggcgaacacatcggtcgcacagtcgaggcctacgtcgatgacatcgtagtcaagacgaggaaagctttcgacctcctctccgaccttgaagtgacattccgatgtctcaaggcgaaaggcgtcaagctcaatcccgagaagtgtgtcttcggggtgccccggggcctgctcttgggttcatcgtctccgagtggggcatcgaagccaacccggagaagatcgcagccatcaccagcatgggtccccatcaggactttaagggcgtacagagggtcatgggatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactcatgtggtggattctatctatcaccttgtcctcacgagtgggagataattgacaccaccctctttggtggtgagacctctactattgatcctctgcctaacaagcatacatcctggtatattaagcgtgtgactagctgactctcttccgtgcccacttgatgctgcaggattatactgtcttgtagtgtgtgtcttctgttgccgccaaggcctcaatacacaccctgccctgtgcttgtacatcttgcctctcctttcctcttgattatggtatctcgcactttcttctggctatccacaggagatgttggaaatgagcgacagtctcttctcgctgagctggacgagtgaagtatccatgtcatttagacgggggagtgagtaaaattctcccgactcgccgcttacgcgcactttcacccgaccatgaggtccctgtcttctactcagtccagaaggctcgaaggatcacttcggctcaatagcttcccaacctcaagacttgttcggaccccccaatcactttatcccaatgcgagttacttatcacagaaggtgatgagtgaggtatccgtatccctgatgcgtacgaatccctcttctccgtcagccttggctgc

SEQ ID NO: 670 - DNA, 281769 bp, Homo sapiens
  misc_feature (655)..(655): n is a, c, g, or t
  misc_feature (812)..(812): n is a, c, g, or t
  misc_feature (815)..(815): n is a, c, g, or t
  misc_feature (824)..(824): n is a, c, g, or t
  misc_feature (852)..(852): n is a, c, g, or t
  misc_feature (969)..(969): n is a, c, g, or t
  misc_feature (1376)..(1376): n is a, c, g, or t
  misc_feature (1419)..(1419): n is a, c, g, or t
  misc_feature (1498)..(1498): n is a, c, g, or t
  misc_feature (1713)..(1713): n is a, c, g, or t
  misc_feature (1719)..(1719): n is a, c, g, or t
  misc_feature (1788)..(1788): n is a, c, g, or t
  misc_feature (1845)..(1845): n is a, c, g, or t
  misc_feature (1916)..(1916): n is a, c, g, or t
  misc_feature (2723)..(2723): n is a, c, g, or t
  misc_feature (2974)..(2974): n is a, c, g, or t
  misc_feature (3214)..(3214): n is a, c, g, or t
  misc_feature (3274)..(3274): n is a, c, g, or t
  misc_feature (3351)..(3357): n is a, c, g, or t
  misc_feature (3359)..(3367): n is a, c, g, or t
  misc_feature (3369)..(3369): n is a, c, g, or t
  misc_feature (3371)..(3374): n is a, c, g, or t
  misc_feature (3376)..(3383): n is a, c, g, or t
  misc_feature (3385)..(3385): n is a, c, g, or t
  misc_feature (3387)..(3387): n is a, c, g, or t
  misc_feature (3389)..(3393): n is a, c, g, or t
  misc_feature (3396)..(3396): n is a, c, g, or t
  misc_feature (3398)..(3398): n is a, c, g, or t
  misc_feature (3400)..(3401): n is a, c, g, or t
  misc_feature (3417)..(3417): n is a, c, g, or t
  misc_feature (3421)..(3421): n is a, c, g, or t
  misc_feature (3433)..(3433): n is a, c, g, or t
  misc_feature (3451)..(3451): n is a, c, g, or t
  misc_feature (3490)..(3496): n is a, c, g, or t
  misc_feature (3499)..(3499): n is a, c, g, or t
  misc_feature (3503)..(3506): n is a, c, g, or t
  misc_feature (3514)..(3514): n is a, c, g, or t
  misc_feature (3518)..(3518): n is a, c, g, or t
  misc_feature (3526)..(3526): n is a, c, g, or t
  misc_feature (3530)..(3530): n is a, c, g, or t
  misc_feature (3538)..(3538): n is a, c, g, or t
  misc_feature (3548)..(3548): n is a, c, g, or t
  misc_feature (3553)..(3554): n is a, c, g, or t
  misc_feature (3557)..(3557): n is a, c, g, or t
  misc_feature (3562)..(3562): n is a, c, g, or t
  misc_feature (3567)..(3567): n is a, c, g, or t
  misc_feature (3585)..(3585): n is a, c, g, or t
  misc_feature (3596)..(3596): n is a, c, g, or t
  misc_feature (3608)..(3608): n is a, c, g, or t
  misc_feature (3700)..(3700): n is a, c, g, or t
  misc_feature (3935)..(3935): n is a, c, g, or t
  misc_feature (4387)..(4387): n is a, c, g, or t
  misc_feature (4401)..(4401): n is a, c, g, or t
  misc_feature (4487)..(4487): n is a, c, g, or t
  misc_feature (4654)..(4654): n is a, c, g, or t
  misc_feature (4660)..(4660): n is a, c, g, or t
  misc_feature (4819)..(4819): n is a, c, g, or t
  misc_feature (4825)..(4825): n is a, c, g, or t
  misc_feature (4834)..(4834): n is a, c, g, or t
  misc_feature (4963)..(4963): n is a, c, g, or t
  misc_feature (5379)..(5379): n is a, c, g, or t
  misc_feature (5385)..(5385): n is a, c, g, or t
  misc_feature (5423)..(5423): n is a, c, g, or t
  misc_feature (5453)..(5453): n is a, c, g, or t
  misc_feature (5481)..(5481): n is a, c, g, or t
  misc_feature (6232)..(6232): n is a, c, g, or t
  misc_feature (6318)..(6318): n is a, c, g, or t
  misc_feature (6395)..(6395): n is a, c, g, or t
  misc_feature (6415)..(6415): n is a, c, g, or t
  misc_feature (6482)..(6482): n is a, c, g, or t
  misc_feature (6704)..(6704): n is a, c, g, or t
  misc_feature (6814)..(6814): n is a, c, g, or t
  misc_feature (6836)..(6836): n is a, c, g, or t
  misc_feature (6865)..(6865): n is a, c, g, or t
  misc_feature (7189)..(7189): n is a, c, g, or t
  misc_feature (7486)..(7486): n is a, c, g, or t
  misc_feature (7870)..(7870): n is a, c, g, or t
  misc_feature (7938)..(7938): n is a, c, g, or t
  misc_feature (8178)..(8178): n is a, c, g, or t
  misc_feature (8182)..(8182): n is a, c, g, or t
  misc_feature (8426)..(8426): n is a, c, g, or t
  misc_feature (8438)..(8438): n is a, c, g, or t
  misc_feature (8619)..(8619): n is a, c, g, or t
  misc_feature (8861)..(8861): n is a, c, g, or t
  misc_feature (8902)..(8902): n is a, c, g, or t
  misc_feature (8904)..(8904): n is a, c, g, or t
  misc_feature (8913)..(8913): n is a, c, g, or t
  misc_feature (8931)..(8931): n is a, c, g, or t
  misc_feature (8959)..(8959): n is a, c, g, or t
  misc_feature (9126)..(9126): n is a, c, g, or t
  misc_feature (9207)..(9207): n is a, c, g, or t
  misc_feature (9371)..(9371): n is a, c, g, or t
  misc_feature (9405)..(9405): n is a, c, g, or t
  misc_feature (9415)..(9415): n is a, c, g, or t
  misc_feature (9588)..(9588): n is a, c, g, or t
  misc_feature (9850)..(9850): n is a, c, g, or t
  misc_feature (10048)..(10048): n is a, c, g, or t
  misc_feature (10064)..(10064): n is a, c, g, or t
  misc_feature (10067)..(10067): n is a, c, g, or t
  misc_feature (10071)..(10071): n is a, c, g, or t
  misc_feature (10074)..(10074): n is a, c, g, or t
  misc_feature (10193)..(10193): n is a, c, g, or t
  misc_feature (10229)..(10229): n is a, c, g, or t
  misc_feature (10236)..(10236): n is a, c, g, or t
  misc_feature (10309)..(10309): n is a, c, g, or t
  misc_feature (10407)..(10407): n is a, c, g, or t
  misc_feature (10413)..(10413): n is a, c, g, or t
  misc_feature (10423)..(10423): n is a, c, g, or t
  misc_feature (10475)..(10475): n is a, c, g, or t
  misc_feature (10538)..(10538): n is a, c, g, or t
  misc_feature (10578)..(10578): n is a, c, g, or t
  misc_feature (10744)..(10744): n is a, c, g, or t
  misc_feature (10770)..(10770): n is a, c, g, or t
  misc_feature (10784)..(10784): n is a, c, g, or t
  misc_feature (10792)..(10792): n is a, c, g, or t
  misc_feature (11118)..(11118): n is a, c, g, or t
  misc_feature (11436)..(11436): n is a, c, g, or t
  misc_feature (11442)..(11442): n is a, c, g, or t
  misc_feature (11449)..(11449): n is a, c, g, or t
  misc_feature (11613)..(11613): n is a, c, g, or t
  misc_feature (11615)..(11615): n is a, c, g, or t
  misc_feature (11646)..(11646): n is a, c, g, or t
  misc_feature (11648)..(11648): n is a, c, g, or t
  misc_feature (12292)..(12292): n is a, c, g, or t
  misc_feature (12310)..(12310): n is a, c, g, or t
  misc_feature (12518)..(12518): n is a, c, g, or t
  misc_feature (12549)..(12549): n is a, c, g, or t
  misc_feature (12647)..(12647): n is a, c, g, or t
  misc_feature (12859)..(12859): n is a, c, g, or t
  misc_feature (12861)..(12863): n is a, c, g, or t
  misc_feature (12865)..(12866): n is a, c, g, or t
  misc_feature (13276)..(13276): n is a, c, g, or t
  misc_feature (13510)..(13510): n is a, c, g, or t
  misc_feature (13774)..(13774): n is a, c, g, or t
  misc_feature (13789)..(13789): n is a, c, g, or t
  misc_feature (13861)..(13861): n is a, c, g, or t
  misc_feature (13868)..(13868): n is a, c, g, or t
  misc_feature (14050)..(14050): n is a, c, g, or t
  misc_feature (14147)..(14147): n is a, c, g, or t
  misc_feature (14331)..(14331): n is a, c, g, or t
  misc_feature (14458)..(14458): n is a, c, g, or t
  misc_feature (15381)..(15381): n is a, c, g, or t
  misc_feature (15395)..(15395): n is a, c, g, or t
  misc_feature (15469)..(15469): n is a, c, g, or t
  misc_feature (15775)..(15775): n is a, c, g, or t
  misc_feature (15842)..(15842): n is a, c, g, or t
  misc_feature (16008)..(16008): n is a, c, g, or t
  misc_feature (16199)..(16199): n is a, c, g, or t
  misc_feature (16205)..(16205): n is a, c, g, or t
  misc_feature (16211)..(16211): n is a, c, g, or t
  misc_feature (16220)..(16220): n is a, c, g, or t
  misc_feature (16302)..(16302): n is a, c, g, or t
  misc_feature (16378)..(16378): n is a, c, g, or t
  misc_feature (16448)..(16448): n is a, c, g, or t
  misc_feature (16493)..(16493): n is a, c, g, or t
  misc_feature (16712)..(16712): n is a, c, g, or t
  misc_feature (16716)..(16716): n is a, c, g, or t
  misc_feature (16733)..(16733): n is a, c, g, or t
  misc_feature (16736)..(16736): n is a, c, g, or t
  misc_feature (16761)..(16761): n is a, c, g, or t
  misc_feature (16769)..(16769): n is a, c, g, or t
  misc_feature (16774)..(16774): n is a, c, g, or t
  misc_feature (16777)..(16777): n is a, c, g, or t
  misc_feature (16779)..(16779): n is a, c, g, or t
  misc_feature (16783)..(16783): n is a, c, g, or t
  misc_feature (16785)..(16786): n is a, c, g, or t
  misc_feature (16788)..(16792): n is a, c, g, or t
  misc_feature (16794)..(16796): n is a, c, g, or t
  misc_feature (16798)..(16799): n is a, c, g, or t
  misc_feature (16802)..(16803): n is a, c, g, or t
  misc_feature (16805)..(16810): n is a, c, g, or t
  misc_feature (16812)..(16812): n is a, c, g, or t
  misc_feature (16814)..(16815): n is a, c, g, or t
  misc_feature (16817)..(16817): n is a, c, g, or t
  misc_feature (16819)..(16830): n is a, c, g, or t
  misc_feature (16832)..(16834): n is a, c, g, or t
  misc_feature (16836)..(16838): n is a, c, g, or t
  misc_feature (16840)..(16840): n is a, c, g, or t
  misc_feature (16842)..(16846): n is a, c, g, or t
  misc_feature (16848)..(16857): n is a, c, g, or t
  misc_feature (16859)..(16859): n is a, c, g, or t
  misc_feature (16861)..(16862): n is a, c, g, or t
  misc_feature (16864)..(16868): n is a, c, g, or t
  misc_feature (16870)..(16871): n is a, c, g, or t
  misc_feature (16874)..(16875): n is a, c, g, or t
  misc_feature (16877)..(16881): n is a, c, g, or t
  misc_feature (16883)..(16885): n is a, c, g, or t
  misc_feature (16888)..(16888): n is a, c, g, or t
  misc_feature (16891)..(16891): n is a, c, g, or t
  misc_feature (16893)..(16893): n is a, c, g, or t
  misc_feature (16896)..(16903): n is a, c, g, or t
  misc_feature (16905)..(16906): n is a, c, g, or t
  misc_feature (16908)..(16911): n is a, c, g, or t
  misc_feature (16913)..(16914): n is a, c, g, or t
  misc_feature (16916)..(16918): n is a, c, g, or t
  misc_feature (16920)..(16923): n is a, c, g, or t
  misc_feature (16925)..(16925): n is a, c, g, or t
  misc_feature (16928)..(16928): n is a, c, g, or t
  misc_feature (16930)..(16930): n is a, c, g, or t
  misc_feature (16932)..(16938): n is a, c, g, or t
  misc_feature (16940)..(16941): n is a, c, g, or t
  misc_feature (16944)..(16944): n is a, c, g, or t
  misc_feature (16946)..(16946): n is a, c, g, or t
  misc_feature (16949)..(16951): n is a, c, g, or t
  misc_feature (16953)..(16954): n is a, c, g, or t
  misc_feature (16957)..(16960): n is a, c, g, or t
  misc_feature (16962)..(16965): n is a, c, g, or t
  misc_feature (16969)..(16972): n is a, c, g, or t
  misc_feature (16974)..(17075): n is a, c, g, or t
  misc_feature (17684)..(17686): n is a, c, g, or t
  misc_feature (17688)..(17688): n is a, c, g, or t
  misc_feature (17690)..(17691): n is a, c, g, or t
  misc_feature (17693)..(17699): n is a, c, g, or t
  misc_feature (17701)..(17703): n is a, c, g, or t
  misc_feature (17705)..(17705): n is a, c, g, or t
  misc_feature (17710)..(17711): n is a, c, g, or t
  misc_feature (17719)..(17719): n is a, c, g, or t
  misc_feature (17732)..(17732): n is a, c, g, or t
  misc_feature (17746)..(17747): n is a, c, g, or t
  misc_feature (17757)..(17757): n is a, c, g, or t
  misc_feature (17861)..(17861): n is a, c, g, or t
  misc_feature (18515)..(18515): n is a, c, g, or t
  misc_feature (18544)..(18544): n is a, c, g, or t
  misc_feature (18558)..(18558): n is a, c, g, or t
  misc_feature (18568)..(18568): n is a, c, g, or t
  misc_feature (18571)..(18571): n is a, c, g, or t
  misc_feature (18738)..(18738): n is a, c, g, or t
  misc_feature (18953)..(18953): n is a, c, g, or t
  misc_feature (19038)..(19038): n is a, c, g, or t
  misc_feature (19040)..(19040): n is a, c, g, or t
  misc_feature (19045)..(19045): n is a, c, g, or t
  misc_feature (19069)..(19069): n is a, c, g, or t
  misc_feature (19072)..(19072): n is a, c, g, or t
  misc_feature (19111)..(19112): n is a, c, g, or t
  misc_feature (19686)..(19686): n is a, c, g, or t
  misc_feature (19837)..(19837): n is a, c, g, or t
  misc_feature (19910)..(19910): n is a, c, g, or t
  misc_feature (19919)..(19919): n is a, c, g, or t
  misc_feature (20028)..(20028): n is a, c, g, or t
  misc_feature (20149)..(20149): n is a, c, g, or t
  misc_feature (20230)..(20230): n is a, c, g, or t
  misc_feature (20360)..(20360): n is a, c, g, or t
  misc_feature (20561)..(20561): n is a, c, g, or t
  misc_feature (20989)..(20989): n is a, c, g, or t
  misc_feature (21131)..(21131): n is a, c, g, or t
  misc_feature (21418)..(21418): n is a, c, g, or t
  misc_feature (21617)..(21617): n is a, c, g, or t
  misc_feature (21646)..(21646): n is a, c, g, or t
  misc_feature (21655)..(21655): n is a, c, g, or t
  misc_feature (21658)..(21658): n is a, c, g, or t
  misc_feature (21715)..(21715): n is a, c, g, or t
  misc_feature (21840)..(21840): n is a, c, g, or t
  misc_feature (21882)..(21882): n is a, c, g, or t
  misc_feature (22353)..(22353): n is a, c, g, or t
  misc_feature (22359)..(22359): n is a, c, g, or t
  misc_feature (22401)..(22401): n is a, c, g, or t
  misc_feature (22747)..(22747): n is a, c, g, or t
  misc_feature (22874)..(22874): n is a, c, g, or t
  misc_feature (22915)..(22915): n is a, c, g, or t
  misc_feature (22921)..(22921): n is a, c, g, or t
  misc_feature (23032)..(23032): n is a, c, g, or t
  misc_feature (24005)..(24005): n is a, c, g, or t
  misc_feature (24110)..(24111): n is a, c, g, or t
  misc_feature (24113)..(24113): n is a, c, g, or t
  misc_feature (24117)..(24117): n is a, c, g, or t
  misc_feature (24119)..(24119): n is a, c, g, or t
  misc_feature (24130)..(24132): n is a, c, g, or t
  misc_feature (24214)..(24214): n is a, c, g, or t
  misc_feature (24216)..(24216): n is a, c, g, or t
  misc_feature (24221)..(24221): n is a, c, g, or t
  misc_feature (24226)..(24227): n is a, c, g, or t
  misc_feature (24238)..(24238): n is a, c, g, or t
  misc_feature (24240)..(24240): n is a, c, g, or t
  misc_feature (24262)..(24262): n is a, c, g, or t
  misc_feature (24264)..(24264): n is a, c, g, or t
  misc_feature (24273)..(24273): n is a, c, g, or t
  misc_feature (24295)..(24296): n is a, c, g, or t
  misc_feature (24298)..(24298): n is a, c, g, or t
  misc_feature (24301)..(24301): n is a, c, g, or t
  misc_feature (24303)..(24303): n is a, c, g, or t
  misc_feature (24315)..(24315): n is a, c, g, or t
  misc_feature (24332)..(24332): n is a, c, g, or t
  misc_feature (24350)..(24350): n is a, c, g, or t
  misc_feature (24684)..(24684): n is a, c, g, or t
  misc_feature (24688)..(24688): n is a, c, g, or t
  misc_feature (24690)..(24690): n is a, c, g, or t
  misc_feature (24694)..(24694): n is a, c, g, or t
  misc_feature (24737)..(24737): n is a, c, g, or t
  misc_feature (24749)..(24749): n is a, c, g, or t
  misc_feature (24751)..(24751): n is a, c, g, or t
  misc_feature (24761)..(24761): n is a, c, g, or t
  misc_feature (24834)..(24834): n is a, c, g, or t
  misc_feature (24880)..(24880): n is a, c, g, or t
  misc_feature (24909)..(24909): n is a, c, g, or t
  misc_feature (24911)..(24911): n is a, c, g, or t
  misc_feature (25026)..(25026): n is a, c, g, or t
  misc_feature (25034)..(25034): n is a, c, g, or t
  misc_feature (25186)..(25186): n is a, c, g, or t
  misc_feature (25311)..(25311): n is a, c, g, or t
  misc_feature (25522)..(25522): n is a, c, g, or t
  misc_feature (25583)..(25583): n is a, c, g, or t
  misc_feature (25811)..(25811): n is a, c, g, or t
  misc_feature (25934)..(25934): n is a, c, g, or t
  misc_feature (26158)..(26158): n is a, c, g, or t
  misc_feature (26161)..(26161): n is a, c, g, or t
  misc_feature (26190)..(26190): n is a, c, g, or t
  misc_feature (26274)..(26274): n is a, c, g, or t
  misc_feature (26359)..(26359): n is a, c, g, or t
  misc_feature (26362)..(26362): n is a, c, g, or t
  misc_feature (26364)..(26364): n is a, c, g, or t
  misc_feature (26773)..(26773): n is a, c, g, or t
  misc_feature (26779)..(26779): n is a, c, g, or t
  misc_feature (26781)..(26781): n is a, c, g, or t
  misc_feature (26803)..(26803): n is a, c, g, or t
  misc_feature (26870)..(26870): n is a, c, g, or t
  misc_feature (26947)..(26947): n is a, c, g, or t
  misc_feature (27070)..(27070): n is a, c, g, or t
  misc_feature (27357)..(27357): n is a, c, g, or t
  misc_feature (27372)..(27372): n is a, c, g, or t
  misc_feature (27426)..(27426): n is a, c, g, or t
  misc_feature (27446)..(27446): n is a, c, g, or t
  misc_feature (27452)..(27452): n is a, c, g, or t
  misc_feature (27906)..(27906): n is a, c, g, or t
  misc_feature (28151)..(28151): n is a, c, g, or t
  misc_feature (28191)..(28191): n is a, c, g, or t
  misc_feature (28341)..(28341): n is a, c, g, or t
  misc_feature (28376)..(28376): n is a, c, g, or t
  misc_feature (28475)..(28475): n is a, c, g, or t
  misc_feature (28634)..(28634): n is a, c, g, or t
  misc_feature (28742)..(28742): n is a, c, g, or t
  misc_feature (29180)..(29180): n is a, c, g, or t
  misc_feature (29212)..(29212): n is a, c, g, or t
  misc_feature (29362)..(29362): n is a, c, g, or t
  misc_feature (29482)..(29482): n is a, c, g, or t
  misc_feature (29490)..(29490): n is a, c, g, or t
  misc_feature (29666)..(29666): n is a, c, g, or t
  misc_feature (29743)..(29743): n is a, c, g, or t
  misc_feature (29819)..(29819): n is a, c, g, or t
  misc_feature (29847)..(29847): n is a, c, g, or t
  misc_feature (29849)..(29849): n is a, c, g, or t
  misc_feature (29946)..(29946): n is a, c, g, or t
  misc_feature (30116)..(30116): n is a, c, g, or t
  misc_feature (30196)..(30196): n is a, c, g, or t
  misc_feature (30220)..(30220): n is a, c, g, or t
  misc_feature (30547)..(30547): n is a, c, g, or t
  misc_feature (30822)..(30822): n is a, c, g, or t
  misc_feature (30901)..(30901): n is a, c, g, or t
  misc_feature (30946)..(30946): n is a, c, g, or t
  misc_feature (31007)..(31007): n is a, c, g, or t
  misc_feature (31021)..(31021): n is a, c, g, or t
  misc_feature (31024)..(31024): n is a, c, g, or t
  misc_feature (31030)..(31030): n is a, c, g, or t
  misc_feature (31067)..(31067): n is a, c, g, or t
  misc_feature (31159)..(31159): n is a, c, g, or t
  misc_feature (31300)..(31300): n is a, c, g, or t
  misc_feature (31698)..(31699): n is a, c, g, or t
  misc_feature (31711)..(31711): n is a, c, g, or t
  misc_feature (32212)..(32212): n is a, c, g, or t
  misc_feature (32215)..(32215): n is a, c, g, or t
  misc_feature (32218)..(32218): n is a, c, g, or t
  misc_feature (33094)..(33094): n is a, c, g, or t
  misc_feature (33096)..(33096): n is a, c, g, or t
  misc_feature (33102)..(33102): n is a, c, g, or t
  misc_feature (33209)..(33209): n is a, c, g, or t
  misc_feature (33551)..(33551): n is a, c, g, or t
  misc_feature (33596)..(33596): n is a, c, g, or t
  misc_feature (34117)..(34117): n is a, c, g, or t
  misc_feature (34365)..(34365): n is a, c, g, or t
  misc_feature (34850)..(34850): n is a, c, g, or t
  misc_feature (34856)..(34856): n is a, c, g, or t
  misc_feature (34966)..(34966): n is a, c, g, or t
  misc_feature (35540)..(35540): n is a, c, g, or t
  misc_feature (35610)..(35610): n is a, c, g, or t
  misc_feature (35806)..(35806): n is a, c, g, or t
  misc_feature (36248)..(36248): n is a, c, g, or t
  misc_feature (36392)..(36392): n is a, c, g, or t
  misc_feature (36428)..(36428): n is a, c, g, or t
  misc_feature (36513)..(36513): n is a, c, g, or t
  misc_feature (36523)..(36523): n is a, c, g, or t
  misc_feature (36969)..(36969): n is a, c, g, or t
  misc_feature (37080)..(37080): n is a, c, g, or t
  misc_feature (37285)..(37285): n is a, c, g, or t
  misc_feature (37320)..(37320): n is a, c, g, or t
  misc_feature (37395)..(37395): n is a, c, g, or t
  misc_feature (37450)..(37450): n is a, c, g, or t
  misc_feature (37664)..(37664): n is a, c, g, or t
  misc_feature (37680)..(37680): n is a, c, g, or t
  misc_feature (38253)..(38253): n is a, c, g, or t
  misc_feature (38266)..(38266): n is a, c, g, or t
  misc_feature (38292)..(38292): n is a, c, g, or t
  misc_feature (38529)..(38529): n is a, c, g, or t
  misc_feature (38532)..(38533): n is a, c, g, or t
  misc_feature (38537)..(38539): n is a, c, g, or t
  misc_feature (38542)..(38542): n is a, c, g, or t
  misc_feature (38544)..(38544): n is a, c, g, or t
  misc_feature (38573)..(38573): n is a, c, g, or t
  misc_feature (38576)..(38576): n is a, c, g, or t
  misc_feature (38593)..(38593): n is a, c, g, or t
  misc_feature (38606)..(38607): n is a, c, g, or t
  misc_feature (38623)..(38623): n is a, c, g, or t
  misc_feature (38627)..(38627): n is a, c, g, or t
  misc_feature (38799)..(38799): n is a, c, g, or t
  misc_feature (39411)..(39411): n is a, c, g, or t
  misc_feature (39830)..(39830): n is a, c, g, or t
  misc_feature (40022)..(40022): n is a, c, g, or t
  misc_feature (40318)..(40318): n is a, c, g, or t
  misc_feature (40346)..(40346): n is a, c, g, or t
  misc_feature (40352)..(40352): n is a, c, g, or t
  misc_feature (40356)..(40356): n is a, c, g, or t
  misc_feature (40966)..(40966): n is a, c, g, or t
  misc_feature (41339)..(41339): n is a, c, g, or t
  misc_feature (41495)..(41495): n is a, c, g, or t
  misc_feature (41497)..(41497): n is a, c, g, or t
  misc_feature (41613)..(41613): n is a, c, g, or t
  misc_feature (41896)..(41896): n is a, c, g, or t
  misc_feature (42257)..(42257): n is a, c, g, or t
  misc_feature (43008)..(43008): n is a, c, g, or t
  misc_feature (43048)..(43048): n is a, c, g, or t
  misc_feature (43078)..(43078): n is a, c, g, or t
  misc_feature (43096)..(43096): n is a, c, g, or t
  misc_feature (43409)..(43409): n is a, c, g, or t
  misc_feature (43457)..(43457): n is a, c, g, or t
  misc_feature (44136)..(44136): n is a, c, g, or t
  misc_feature (44156)..(44156): n is a, c, g, or t
  misc_feature (44272)..(44272): n is a, c, g, or t
  misc_feature (44421)..(44421): n is a, c, g, or t
  misc_feature (44584)..(44584): n is a, c, g, or t
  misc_feature (44588)..(44588): n is a, c, g, or t
  misc_feature (44640)..(44640): n is a, c, g, or t
  misc_feature (44706)..(44706): n is a, c, g, or t
  misc_feature (45159)..(45159): n is a, c, g, or t
  misc_feature (46232)..(46232): n is a, c, g, or t
  misc_feature (46603)..(46603): n is a, c, g, or t
  misc_feature (46746)..(46746): n is a, c, g, or t
  misc_feature (46793)..(46793): n is a, c, g, or t
  misc_feature (46797)..(46797): n is a, c, g, or t
  misc_feature (46957)..(46957): n is a, c, g, or t
  misc_feature (46963)..(46963): n is a, c, g, or t
  misc_feature (46966)..(46966): n is a, c, g, or t
  misc_feature (46972)..(46972): n is a, c, g, or t
  misc_feature (47004)..(47004): n is a, c, g, or t
  misc_feature (47047)..(47047): n is a, c, g, or t
  misc_feature (47059)..(47059): n is a, c, g, or t
  misc_feature (47107)..(47107): n is a, c, g, or t
  misc_feature (47256)..(47256): n is a, c, g, or t
  misc_feature (47349)..(47349): n is a, c, g, or t
  misc_feature (47355)..(47356): n is a, c, g, or t
  misc_feature (47360)..(47360): n is a, c, g, or t
  misc_feature (47623)..(47623): n is a, c, g, or t
  misc_feature (47693)..(47693): n is a, c, g, or t
  misc_feature (47770)..(47770): n is a, c, g, or t
  misc_feature (47816)..(47816): n is a, c, g, or t
  misc_feature (47981)..(47981): n is a, c, g, or t
  misc_feature (48331)..(48331): n is a, c, g, or t
  misc_feature (48449)..(48449): n is a, c, g, or t
  misc_feature (48823)..(48823): n is a, c, g, or t
  misc_feature (49034)..(49034): n is a, c, g, or t
  misc_feature (49059)..(49059): n is a, c, g, or t
  misc_feature (49220)..(49220): n is a, c, g, or t
  misc_feature (49231)..(49231): n is a, c, g, or t
  misc_feature (49493)..(49493): n is a, c, g, or t
  misc_feature (49509)..(49509): n is a, c, g, or t
  misc_feature (49533)..(49533): n is a, c, g, or t
  misc_feature (49540)..(49540): n is a, c, g, or t
  misc_feature (49556)..(49556): n is a, c, g, or t
  misc_feature (49685)..(49685): n is a, c, g, or t
  misc_feature (49786)..(49786): n is a, c, g, or t
  misc_feature (49991)..(49991): n is a, c, g, or t
  misc_feature (50240)..(50240): n is a, c, g, or t
  misc_feature (50274)..(50274): n is a, c, g, or t
  misc_feature (50278)..(50278): n is a, c, g, or t
  misc_feature (50551)..(50551): n is a, c, g, or t
  misc_feature (50814)..(50814): n is a, c, g, or t
  misc_feature (50870)..(50870): n is a, c, g, or t
  misc_feature (51289)..(51289): n is a, c, g, or t
  misc_feature (51390)..(51390): n is a, c, g, or t
  misc_feature (51642)..(51642): n is a, c, g, or t
  misc_feature (51713)..(51713): n is a, c, g, or t
  misc_feature (51832)..(51832): n is a, c, g, or t
  misc_feature (51836)..(51836): n is a, c, g, or t
  misc_feature (52174)..(52174): n is a, c, g, or t
  misc_feature (52292)..(52292): n is a, c, g, or t
  misc_feature (52476)..(52476): n is a, c, g, or t
  misc_feature (52772)..(52772): n is a, c, g, or t
  misc_feature (53159)..(53159): n is a, c, g, or t
  misc_feature (53161)..(53161): n is a, c, g, or t
  misc_feature (53186)..(53186): n is a, c, g, or t
  misc_feature (53325)..(53325): n is a, c, g, or t
  misc_feature (53420)..(53420): n is a, c, g, or t
  misc_feature (53427)..(53427): n is a, c, g, or t
  misc_feature (53430)..(53430): n is a, c, g, or t
  misc_feature (53434)..(53435): n is a, c, g, or t
  misc_feature (53541)..(53541): n is a, c, g, or t
  misc_feature (53693)..(53693): n is a, c, g, or t
  misc_feature (53728)..(53728): n is a, c, g, or t
  misc_feature (54120)..(54120): n is a, c, g, or t
  misc_feature (54144)..(54144): n is a, c, g, or t
  misc_feature (54214)..(54214): n is a, c, g, or t
  misc_feature (54271)..(54271): n is a, c, g, or t
  misc_feature (54362)..(54362): n is a, c, g, or t
  misc_feature (54469)..(54469): n is a, c, g, or t
  misc_feature (54489)..(54490): n is a, c, g, or t
  misc_feature (54762)..(54762): n is a, c, g, or t
  misc_feature (55158)..(55158): n is a, c, g, or t
  misc_feature (55211)..(55211): n is a, c, g, or t
  misc_feature (55215)..(55215): n is a, c, g, or t
  misc_feature (55231)..(55231): n is a, c, g, or t
  misc_feature (55428)..(55428): n is a, c, g, or t
  misc_feature (55441)..(55441): n is a, c, g, or t
  misc_feature (55464)..(55464): n is a, c, g, or t
  misc_feature (55486)..(55486): n is a, c, g, or t
  misc_feature (55496)..(55496): n is a, c, g, or t
  misc_feature (55544)..(55544): n is a, c, g, or t
  misc_feature (55591)..(55591): n is a, c, g, or t
  misc_feature (55681)..(55681): n is a, c, g, or t
  misc_feature (55840)..(55841): n is a, c, g, or t
  misc_feature (55843)..(55846): n is a, c, g, or t
  misc_feature (55848)..(55849): n is a, c, g, or t
  misc_feature (55851)..(55852): n is a, c, g, or t
  misc_feature (55856)..(55856): n is a, c, g, or t
  misc_feature (55858)..(55858): n is a, c, g, or t
  misc_feature (55860)..(55865): n is a, c, g, or t
  misc_feature (55868)..(55873): n is a, c, g, or t
  misc_feature (55875)..(55879): n is a, c, g, or t
  misc_feature (55881)..(55882): n is a, c, g, or t
  misc_feature (55884)..(55887): n is a, c, g, or t
  misc_feature (55889)..(55889): n is a, c, g, or t
  misc_feature (55891)..(55891): n is a, c, g, or t
  misc_feature (55893)..(55896): n is a, c, g, or t
  misc_feature (55898)..(55899): n is a, c, g, or t
  misc_feature (55901)..(55901): n is a, c, g, or t
  misc_feature (55903)..(55903): n is a, c, g, or t
  misc_feature (55906)..(55907): n is a, c, g, or t
  misc_feature (55909)..(55913): n is a, c, g, or t
  misc_feature (55915)..(55917): n is a, c, g, or t
  misc_feature (55919)..(55920): n is a, c, g, or t
  misc_feature (55922)..(55926): n is a, c, g, or t
  misc_feature (55930)..(55931): n is a, c, g, or t
  misc_feature (55934)..(55953): n is a, c, g, or t
  misc_feature (55956)..(55963): n is a, c, g, or t
  misc_feature (55965)..(55968): n is a, c, g, or t
  misc_feature (55971)..(55972): n is a, c, g, or t
  misc_feature (55974)..(55976): n is a, c, g, or t
  misc_feature (55979)..(55993): n is a, c, g, or t
  misc_feature (55995)..(56008): n is a, c, g, or t
  misc_feature (56012)..(56015): n is a, c, g, or t
  misc_feature (56017)..(56017): n is a, c, g, or t
  misc_feature (56020)..(56022): n is a, c, g, or t
  misc_feature (56024)..(56027): n is a, c, g, or t
  misc_feature (56029)..(56030): n is a, c, g, or t
  misc_feature (56032)..(56033): n is a, c, g, or t
  misc_feature (56036)..(56047): n is a, c, g, or t
  misc_feature (56049)..(56054): n is a, c, g, or t
  misc_feature (56056)..(56057): n is a, c, g, or t
  misc_feature (56059)..(56060): n is a, c, g, or t
  misc_feature (56062)..(56062): n is a, c, g, or t
  misc_feature (56064)..(56067): n is a, c, g, or t
  misc_feature (56069)..(56069): n is a, c, g, or t
  misc_feature (56071)..(56072): n is a, c, g, or t
  misc_feature (56074)..(56081): n is a, c, g, or t
  misc_feature (56083)..(56085): n is a, c, g, or t
  misc_feature (56088)..(56092): n is a, c, g, or t
  misc_feature (56094)..(56104): n is a, c, g, or t
  misc_feature (56106)..(56106): n is a, c, g, or t
  misc_feature (56108)..(56122): n is a, c, g, or t
  misc_feature (56125)..(56134): n is a, c, g, or t
  misc_feature (56136)..(56136): n is a, c, g, or t
  misc_feature (56138)..(56138): n is a, c, g, or t
  misc_feature (56140)..(56146): n is a, c, g, or t
  misc_feature (56148)..(56148): n is a, c, g, or t
  misc_feature (56150)..(56156): n is a, c, g, or t
  misc_feature (56159)..(56175): n is a, c, g, or t
  misc_feature (56177)..(56177): n is a, c, g, or t
  misc_feature (56179)..(56184): n is a, c, g, or t
  misc_feature (56186)..(56191): n is a, c, g, or t
  misc_feature (56194)..(56201): n is a, c, g, or t
  misc_feature (56203)..(56220): n is a, c, g, or t
  misc_feature (56222)..(56225): n is a, c, g, or t
  misc_feature (56227)..(56227): n is a, c, g, or t
  misc_feature (56229)..(56231): n is a, c, g, or t
  misc_feature (56233)..(56236): n is a, c, g, or t
  misc_feature (56239)..(56247): n is a, c, g, or t
  misc_feature (56249)..(56253): n is a, c, g, or t
  misc_feature (56256)..(56260): n is a, c, g, or t
  misc_feature (56262)..(56266): n is a, c, g, or t
  misc_feature (56269)..(56271): n is a, c, g, or t
  misc_feature (56273)..(56273): n is a, c, g, or t
  misc_feature (56275)..(56275): n is a, c, g, or t
  misc_feature (56277)..(56280): n is a, c, g, or t
  misc_feature (56282)..(56285): n is a, c, g, or t
  misc_feature (56287)..(56292): n is a, c, g, or t
  misc_feature (56294)..(56297): n is a, c, g, or t
  misc_feature (56301)..(56301): n is a, c, g, or t
  misc_feature (56307)..(56307): n is a, c, g, or t
  misc_feature (56309)..(56310): n is a, c, g, or t
  misc_feature (56312)..(56313): n is a, c, g, or t
  misc_feature (56315)..(56325): n is a, c, g, or t
  misc_feature (56327)..(56328): n is a, c, g, or t
  misc_feature (56331)..(56336): n is a, c, g, or t
  misc_feature (56387)..(56387): n is a, c, g, or t
  misc_feature (56390)..(56390): n is a, c, g, or t
  misc_feature (56425)..(56425): n is a, c, g, or t
  misc_feature (56446)..(56446): n is a, c, g, or t
  misc_feature (56457)..(56457): n is a, c, g, or t
  misc_feature (56539)..(56539): n is a, c, g, or t
  misc_feature (56541)..(56541): n is a, c, g, or t
  misc_feature (56591)..(56604): n is a, c, g, or t
  misc_feature (56606)..(56606): n is a, c, g, or t
  misc_feature (56608)..(56609): n is a, c, g, or t
  misc_feature (56611)..(56616): n is a, c, g, or t
  misc_feature (56619)..(56619): n is a, c, g, or t
  misc_feature (56630)..(56630): n is a, c, g, or t
  misc_feature (56650)..(56650): n is a, c, g, or t
  misc_feature (56748)..(56748): n is a, c, g, or t
  misc_feature (56770)..(56770): n is a, c, g, or t
  misc_feature (56858)..(56858): n is a, c, g, or t
  misc_feature (56881)..(56881): n is a, c, g, or t
  misc_feature (56899)..(56899): n is a, c, g, or t
  misc_feature (56908)..(56908): n is a, c, g, or t
  misc_feature (57003)..(57003): n is a, c, g, or t
  misc_feature (57006)..(57006): n is a, c, g, or t
  misc_feature (57041)..(57041): n is a, c, g, or t
  misc_feature (57057)..(57057): n is a, c, g, or t
  misc_feature (57073)..(57073): n is a, c, g, or t
  misc_feature (57205)..(57205): n is a, c, g, or t
  misc_feature (57213)..(57213): n is a, c, g, or t
  misc_feature (57250)..(57250): n is a, c, g, or t
  misc_feature (57340)..(57340): n is a, c, g, or t
  misc_feature (57347)..(57347): n is a, c, g, or t
  misc_feature (57361)..(57361): n is a, c, g, or t
  misc_feature (57454)..(57454): n is a, c, g, or t
  misc_feature (57901)..(57901): n is a, c, g, or t
  misc_feature (57932)..(57932): n is a, c, g, or t
  misc_feature (58027)..(58027): n is a, c, g, or t
  misc_feature (58050)..(58050): n is a, c, g, or t
  misc_feature (58207)..(58207): n is a, c, g, or t
  misc_feature (58598)..(58598): n is a, c, g, or t
  misc_feature (58704)..(58704): n is a, c, g, or t
  misc_feature (58797)..(58797): n is a, c, g, or t
  misc_feature (58805)..(58806): n is a, c, g, or t
  misc_feature (58828)..(58828): n is a, c, g, or t
  misc_feature (58851)..(58851): n is a, c, g, or t
  misc_feature (58906)..(58906): n is a, c, g, or t
  misc_feature (59232)..(59232): n is a, c, g, or t
  misc_feature (59245)..(59245): n is a, c, g, or t
  misc_feature (59457)..(59457): n is a, c, g, or t
  misc_feature (59539)..(59539): n is a, c, g, or t
  misc_feature (59573)..(59573): n is a, c, g, or t
  misc_feature (59800)..(59800): n is a, c, g, or t
  misc_feature (59835)..(59835): n is a, c, g, or t
  misc_feature (59839)..(59839): n is a, c, g, or t
  misc_feature (59850)..(59850): n is a, c, g, or t
  misc_feature (59900)..(59900): n is a, c, g, or t
  misc_feature (59941)..(59942): n is a, c, g, or t
  misc_feature (60003)..(60003): n is a, c, g, or t
  misc_feature (60027)..(60027): n is a, c, g, or t
  misc_feature (60051)..(60051): n is a, c, g, or t
  misc_feature (60102)..(60102): n is a, c, g, or t
  misc_feature (60138)..(60138): n is a, c, g, or t
  misc_feature (60388)..(60388): n is a, c, g, or t
  misc_feature (60418)..(60418): n is a, c, g, or t
  misc_feature (60446)..(60446): n is a, c, g, or t
  misc_feature (60455)..(60455): n is a, c, g, or t
  misc_feature (60536)..(60536): n is a, c, g, or t
  misc_feature (60553)..(60553): n is a, c, g, or t
  misc_feature (60570)..(60570): n is a, c, g, or t
  misc_feature (60657)..(60657): n is a, c, g, or t
  misc_feature (60664)..(60664): n is a, c, g, or t
  misc_feature (60674)..(60674): n is a, c, g, or t
  misc_feature (60677)..(60677): n is a, c, g, or t
  misc_feature (60680)..(60680): n is a, c, g, or t
  misc_feature (60709)..(60710): n is a, c, g, or t
  misc_feature (61539)..(61539): n is a, c, g, or t
  misc_feature (61716)..(61716): n is a, c, g, or t
  misc_feature (61902)..(61902): n is a, c, g, or t
  misc_feature (61915)..(61915): n is a, c, g, or t
  misc_feature (61917)..(61917): n is a, c, g, or t
  misc_feature (61935)..(61935): n is a, c, g, or t
  misc_feature (62178)..(62178): n is a, c, g, or t
  misc_feature (62211)..(62211): n is a, c, g, or t
  misc_feature (62875)..(62875): n is a, c, g, or t
  misc_feature (62882)..(62882): n is a, c, g, or t
  misc_feature (62887)..(62887): n is a, c, g, or t
  misc_feature (62923)..(62923): n is a, c, g, or t
  misc_feature (63023)..(63023): n is a, c, g, or t
  misc_feature (63385)..(63385): n is a, c, g, or t
  misc_feature (63995)..(63995): n is a, c, g, or t
  misc_feature (64586)..(64586): n is a, c, g, or t
  misc_feature (64867)..(64867): n is a, c, g, or t
  misc_feature (64908)..(64908): n is a, c, g, or t
  misc_feature (65245)..(65245): n is a, c, g, or t
  misc_feature (65660)..(65660): n is a, c, g, or t
  misc_feature (65774)..(65774): n is a, c, g, or t
  misc_feature (65776)..(65777): n is a, c, g, or t
  misc_feature (65782)..(65783): n is a, c, g, or t
  misc_feature (65787)..(65788): n is a, c, g, or t
  misc_feature (65790)..(65792): n is a, c, g, or t
  misc_feature (65794)..(65794): n is a, c, g, or t
  misc_feature (65796)..(65798): n is a, c, g, or t
  misc_feature (65803)..(65804): n is a, c, g, or t
  misc_feature (66150)..(66150): n is a, c, g, or t
  misc_feature (66288)..(66288): n is a, c, g, or t
  misc_feature (66300)..(66300): n is a, c, g, or t
  misc_feature (66304)..(66304): n is a, c, g, or t
  misc_feature (66499)..(66499): n is a, c, g, or t
  misc_feature (66883)..(66883): n is a, c, g, or t
  misc_feature (67049)..(67049): n is a, c, g, or t
  misc_feature (67074)..(67074): n is a, c, g, or t
  misc_feature (67298)..(67298): n is a, c, g, or t
  misc_feature (67428)..(67428): n is a, c, g, or t
  misc_feature (67701)..(67701): n is a, c, g, or t
  misc_feature (68427)..(68427): n is a, c, g, or t
  misc_feature (68626)..(68626): n is a, c, g, or t
  misc_feature (68637)..(68637): n is a, c, g, or t
  misc_feature (68911)..(68911): n is a, c, g, or t
  misc_feature (69007)..(69007): n is a, c, g, or t
  misc_feature (69109)..(69109): n is a, c, g, or t
  misc_feature (69585)..(69585): n is a, c, g, or t
  misc_feature (69736)..(69736): n is a, c, g, or t
  misc_feature (69891)..(69891): n is a, c, g, or t
  misc_feature (69898)..(69898): n is a, c, g, or t
  misc_feature (69926)..(69926): n is a, c, g, or t
  misc_feature (70134)..(70134): n is a, c, g, or t
  misc_feature (71072)..(71072): n is a, c, g, or t
  misc_feature (71215)..(71215): n is a, c, g, or t
  misc_feature (71452)..(71452): n is a, c, g, or t
  misc_feature (71823)..(71823): n is a, c, g, or t
  misc_feature (71825)..(71825): n is a, c, g, or t
  misc_feature (71909)..(71909): n is a, c, g, or t
  misc_feature (71916)..(71916): n is a, c, g, or t
  misc_feature (71920)..(71920): n is a, c, g, or t
  misc_feature (71998)..(71998): n is a, c, g, or t
  misc_feature (72013)..(72013): n is a, c, g, or t
  misc_feature (72188)..(72188): n is a, c, g, or t
  misc_feature (72361)..(72361): n is a, c, g, or t
  misc_feature (72563)..(72563): n is a, c, g, or t
  misc_feature (72828)..(72828): n is a, c, g, or t
  misc_feature (72981)..(72981): n is a, c, g, or t
  misc_feature (73161)..(73161): n is a, c, g, or t
  misc_feature (73303)..(73303): n is a, c, g, or t
  misc_feature (73523)..(73523): n is a, c, g, or t
  misc_feature (73688)..(73688): n is a, c, g, or t
  misc_feature (73827)..(73827): n is a, c, g, or t
  misc_feature (73898)..(73898): n is a, c, g, or t
  misc_feature (74328)..(74328): n is a, c, g, or t
  misc_feature (74331)..(74331): n is a, c, g, or t
  misc_feature (74593)..(74593): n is a, c, g, or t
  misc_feature (74640)..(74640): n is a, c, g, or t
  misc_feature (74666)..(74666): n is a, c, g, or t
  misc_feature (74752)..(74752): n is a, c, g, or t
  misc_feature (74922)..(74922): n is a, c, g, or t
  misc_feature (74933)..(74933): n is a, c, g, or t
  misc_feature (75117)..(75117): n is a, c, g, or t
  misc_feature (75166)..(75166): n is a, c, g, or t
  misc_feature (75512)..(75512): n is a, c, g, or t
  misc_feature (75854)..(75854): n is a, c, g, or t
  misc_feature (75856)..(75856): n is a, c, g, or t
  misc_feature (75861)..(75861): n is a, c, g, or t
  misc_feature (75995)..(75995): n is a, c, g, or t
  misc_feature (75997)..(75997): n is a, c, g, or t
  misc_feature (76000)..(76000): n is a, c, g, or t
  misc_feature (76019)..(76019): n is a, c, g, or t
  misc_feature (76021)..(76021): n is a, c, g, or t
  misc_feature (76024)..(76024): n is a, c, g, or t
  misc_feature (76044)..(76044): n is a, c, g, or t
  misc_feature (76048)..(76048): n is a, c, g, or t
  misc_feature (76059)..(76060): n is a, c, g, or t
  misc_feature (76065)..(76065): n is a, c, g, or t
  misc_feature (76080)..(76080): n is a, c, g, or t
  misc_feature (76085)..(76086): n is a, c, g, or t
  misc_feature (76088)..(76088): n is a, c, g, or t
  misc_feature (76093)..(76094): n is a, c, g, or t
  misc_feature (76097)..(76097): n is a, c, g, or t
  misc_feature (76099)..(76099): n is a, c, g, or t
  misc_feature (76101)..(76102): n is a, c, g, or t
  misc_feature (76112)..(76112): n is a, c, g, or t
  misc_feature (76114)..(76114): n is a, c, g, or t
  misc_feature (76117)..(76117): n is a, c, g, or t
  misc_feature (76120)..(76121): n is a, c, g, or t
  misc_feature (76125)..(76125): n is a, c, g, or t
  misc_feature (76137)..(76139): n is a, c, g, or t
  misc_feature (76141)..(76141): n is a, c, g, or t
  misc_feature (76146)..(76146): n is a, c, g, or t
  misc_feature (76148)..(76148): n is a, c, g, or t
  misc_feature (76153)..(76153): n is a, c, g, or t
  misc_feature (76155)..(76155): n is a, c, g, or t
  misc_feature (76159)..(76160): n is a, c, g, or t
  misc_feature (76162)..(76162): n is a, c, g, or t
  misc_feature (76164)..(76164): n is a, c, g, or t
  misc_feature (76166)..(76173): n is a, c, g, or t
  misc_feature (76175)..(76176): n is a, c, g, or t
  misc_feature (76178)..(76182): n is a, c, g, or t
  misc_feature (76184)..(76185): n is a, c, g, or t
  misc_feature (76187)..(76220): n is a, c, g, or t
  misc_feature (76235)..(76235): n is a, c, g, or t
  misc_feature (76243)..(76244): n is a, c, g, or t
  misc_feature (76248)..(76249): n is a, c, g, or t
  misc_feature (76255)..(76255): n is a, c, g, or t
  misc_feature (76264)..(76264): n is a, c, g, or t
  misc_feature (76266)..(76266): n is a, c, g, or t
  misc_feature (76269)..(76269): n is a, c, g, or t
  misc_feature (76290)..(76291): n is a, c, g, or t
  misc_feature (76302)..(76302): n is a, c, g, or t
  misc_feature (76312)..(76312): n is a, c, g, or t
  misc_feature (76315)..(76315): n is a, c, g, or t
  misc_feature (76321)..(76321): n is a, c, g, or t
  misc_feature (76333)..(76333): n is a, c, g, or t
  misc_feature (76388)..(76388): n is a, c, g, or t
  misc_feature (76421)..(76421): n is a, c, g, or t
  misc_feature (76906)..(76906): n is a, c, g, or t
  misc_feature (76913)..(76913): n is a, c, g, or t
  misc_feature (76939)..(76939): n is a, c, g, or t
  misc_feature (76980)..(76981): n is a, c, g, or t
  misc_feature (76995)..(76995): n is a, c, g, or t
  misc_feature (76997)..(76997): n is a, c, g, or t
  misc_feature (77013)..(77014): n is a, c, g, or t
  misc_feature (77028)..(77028): n is a, c, g, or t
  misc_feature (77035)..(77035): n is a, c, g, or t
  misc_feature (77038)..(77038): n is a, c, g, or t
  misc_feature (77042)..(77042): n is a, c, g, or t
  misc_feature (77047)..(77047): n is a, c, g, or t
  misc_feature (77054)..(77055): n is a, c, g, or t
  misc_feature (77057)..(77060): n is a, c, g, or t
  misc_feature (77062)..(77062): n is a, c, g, or t
  misc_feature (77065)..(77065): n is a, c, g, or t
  misc_feature (77068)..(77069): n is a, c, g, or t
  misc_feature (77071)..(77071): n is a, c, g, or t
  misc_feature (77073)..(77077): n is a, c, g, or t
  misc_feature (77111)..(77111): n is a, c, g, or t
  misc_feature (77203)..(77203): n is a, c, g, or t
  misc_feature (77300)..(77300): n is a, c, g, or t
  misc_feature (77464)..(77464): n is a, c, g, or t
  misc_feature (77491)..(77491): n is a, c, g, or t
  misc_feature (77495)..(77495): n is a, c, g, or t
  misc_feature (77996)..(77996): n is a, c, g, or t
  misc_feature (78001)..(78001): n is a, c, g, or t
  misc_feature (78223)..(78223): n is a, c, g, or t
  misc_feature (78230)..(78230): n is a, c, g, or t
  misc_feature (78237)..(78237): n is a, c, g, or t
  misc_feature (78264)..(78267): n is a, c, g, or t
  misc_feature (78270)..(78274): n is a, c, g, or t
  misc_feature (78276)..(78285): n is a, c, g, or t
  misc_feature (78334)..(78334): n is a, c, g, or t
  misc_feature (78415)..(78415): n is a, c, g, or t
  misc_feature (78418)..(78418): n is a, c, g, or t
  misc_feature (78447)..(78448): n is a, c, g, or t
  misc_feature (78457)..(78457): n is a, c, g, or t
  misc_feature (78474)..(78474): n is a, c, g, or t
  misc_feature (78480)..(78480): n is a, c, g, or t
  misc_feature (78794)..(78794): n is a, c, g, or t
  misc_feature (79762)..(79762): n is a, c, g, or t
  misc_feature (79778)..(79778): n is a, c, g, or t
  misc_feature (80119)..(80119): n is a, c, g, or t
  misc_feature (80196)..(80196): n is a, c, g, or t
  misc_feature (80504)..(80504): n is a, c, g, or t
  misc_feature (80573)..(80573): n is a, c, g, or t
  misc_feature (80633)..(80633): n is a, c, g, or t
  misc_feature (81433)..(81433): n is a, c, g, or t
  misc_feature (81470)..(81470): n is a, c, g, or t
  misc_feature (81538)..(81538): n is a, c, g, or t
  misc_feature (81540)..(81540): n is a, c, g, or t
  misc_feature (81542)..(81542): n is a, c, g, or t
  misc_feature (81562)..(81562): n is a, c, g, or t
  misc_feature (81610)..(81610): n is a, c, g, or t
  misc_feature (81690)..(81690): n is a, c, g, or t
  misc_feature (81693)..(81693): n is a, c, g, or t
  misc_feature (81817)..(81817): n is a, c, g, or t
  misc_feature (82103)..(82103): n is a, c, g, or t
  misc_feature (82105)..(82105): n is a, c, g, or t
  misc_feature (82107)..(82107): n is a, c, g, or t
  misc_feature (82139)..(82139): n is a, c, g, or t
  misc_feature (82146)..(82146): n is a, c, g, or t
  misc_feature (82278)..(82278): n is a, c, g, or t
  misc_feature (82308)..(82308): n is a, c, g, or t
  misc_feature (82410)..(82410): n is a, c, g, or t
  misc_feature (82660)..(82660): n is a, c, g, or t
  misc_feature (82726)..(82726): n is a, c, g, or t
  misc_feature (82733)..(82733): n is a, c, g, or t
  misc_feature (82768)..(82768): n is a, c, g, or t
  misc_feature (82800)..(82800): n is a, c, g, or t
  misc_feature (82941)..(82941): n is a, c, g, or t
  misc_feature (83292)..(83292): n is a, c, g, or t
  misc_feature (83605)..(83605): n is a, c, g, or t
  misc_feature (83745)..(83745): n is a, c, g, or t
  misc_feature (83812)..(83812): n is a, c, g, or t
  misc_feature (83837)..(83837): n is a, c, g, or t
  misc_feature (83875)..(83875): n is a, c, g, or t
  misc_feature (83892)..(83892): n is a, c, g, or t
  misc_feature (83928)..(83928): n is a, c, g, or t
  misc_feature (84130)..(84130): n is a, c, g, or t
  misc_feature (84152)..(84152): n is a, c, g, or t
  misc_feature (84164)..(84164): n is a, c, g, or t
  misc_feature (84285)..(84285): n is a, c, g, or t
  misc_feature (84288)..(84288): n is a, c, g, or t
  misc_feature (84448)..(84448): n is a, c, g, or t
  misc_feature (84464)..(84464): n is a, c, g, or t
  misc_feature (84606)..(84606): n is a, c, g, or t
  misc_feature (84653)..(84653): n is a, c, g, or t
  misc_feature (84788)..(84788): n is a, c, g, or t
  misc_feature (84792)..(84792): n is a, c, g, or t
  misc_feature (84868)..(84868): n is a, c, g, or t
  misc_feature (85043)..(85043): n is a, c, g, or t
  misc_feature (85069)..(85069): n is a, c, g, or t
  misc_feature (85100)..(85100): n is a, c, g, or t
  misc_feature (85135)..(85135): n is a, c, g, or t
  misc_feature (85443)..(85443): n is a, c, g, or t
  misc_feature (85475)..(85475): n is a, c, g, or t
  misc_feature (85730)..(85730): n is a, c, g, or t
  misc_feature (85775)..(85775): n is a, c, g, or t
  misc_feature (86769)..(86769): n is a, c, g, or t
  misc_feature (87326)..(87326): n is a, c, g, or t
  misc_feature (87538)..(87538): n is a, c, g, or t
  misc_feature (87817)..(87817): n is a, c, g, or t
  misc_feature (88668)..(88668): n is a, c, g, or t
  misc_feature (88954)..(88954): n is a, c, g, or t
  misc_feature (89162)..(89162): n is a, c, g, or t
  misc_feature (89317)..(89317): n is a, c, g, or t
  misc_feature (89369)..(89369): n is a, c, g, or t
  misc_feature (89607)..(89607): n is a, c, g, or t
  misc_feature (89812)..(89812): n is a, c, g, or t
  misc_feature (89826)..(89826): n is a, c, g, or t
  misc_feature (90170)..(90170): n is a, c, g, or t
  misc_feature (90174)..(90174): n is a, c, g, or t
  misc_feature (90216)..(90216): n is a, c, g, or t
  misc_feature (90292)..(90292): n is a, c, g, or t
  misc_feature (90295)..(90295): n is a, c, g, or t
  misc_feature (90341)..(90341): n is a, c, g, or t
  misc_feature (90391)..(90391): n is a, c, g, or t
  misc_feature (90645)..(90645): n is a, c, g, or t
  misc_feature (90817)..(90817): n is a, c, g, or t
  misc_feature (90823)..(90823): n is a, c, g, or t
  misc_feature (90825)..(90825): n is a, c, g, or t
  misc_feature (90828)..(90828): n is a, c, g, or t
  misc_feature (90933)..(90933): n is a, c, g, or t
  misc_feature (91017)..(91017): n is a, c, g, or t
  misc_feature (91104)..(91104): n is a, c, g, or t
  misc_feature (91137)..(91137): n is a, c, g, or t
  misc_feature (91302)..(91302): n is a, c, g, or t
  misc_feature (91600)..(91600): n is a, c, g, or t
  misc_feature (92081)..(92081): n is a, c, g, or t
  misc_feature (92367)..(92367): n is a, c, g, or t
  misc_feature (92707)..(92707): n is a, c, g, or t
  misc_feature (92738)..(92738): n is a, c, g, or t
  misc_feature (92813)..(92813): n is a, c, g, or t
  misc_feature (92829)..(92829): n is a, c, g, or t
  misc_feature (93140)..(93140): n is a, c, g, or t
  misc_feature (93229)..(93229): n is a, c, g, or t
  misc_feature (93341)..(93341): n is a, c, g, or t
  misc_feature (93446)..(93446): n is a, c, g, or t
  misc_feature (94091)..(94091): n is a, c, g, or t
  misc_feature (94124)..(94124): n is a, c, g, or t
  misc_feature (94533)..(94533): n is a, c, g, or t
  misc_feature (94536)..(94536): n is a, c, g, or t
  misc_feature (94570)..(94570): n is a, c, g, or t
  misc_feature (94572)..(94572): n is a, c, g, or t
  misc_feature (94594)..(94594): n is a, c, g, or t
  misc_feature (94914)..(94914): n is a, c, g, or t
  misc_feature (95233)..(95233): n is a, c, g, or t
  misc_feature (95365)..(95365): n is a, c, g, or t
  misc_feature (95477)..(95477): n is a, c, g, or t
  misc_feature (95567)..(95567): n is a, c, g, or t
  misc_feature (95996)..(95996): n is a, c, g, or t
  misc_feature (96023)..(96024): n is a, c, g, or t
  misc_feature (96106)..(96106): n is a, c, g, or t
  misc_feature (96127)..(96127): n is a, c, g, or t
  misc_feature (96165)..(96165): n is a, c, g, or t
  misc_feature (96199)..(96199): n is a, c, g, or t
  misc_feature (96214)..(96214): n is a, c, g, or t
  misc_feature (96228)..(96228): n is a, c, g, or t
  misc_feature (96287)..(96287): n is a, c, g, or t
  misc_feature (96289)..(96289): n is a, c, g, or t
  misc_feature (96310)..(96310): n is a, c, g, or t
  misc_feature (96313)..(96313): n is a, c, g, or t
  misc_feature (96317)..(96317): n is a, c, g, or t
  misc_feature (96319)..(96321): n is a, c, g, or t
  misc_feature (96325)..(96325): n is a, c, g, or t
  misc_feature (96327)..(96327): n is a, c, g, or t
  misc_feature (96330)..(96342): n is a, c, g, or t
  misc_feature (96344)..(96344): n is a, c, g, or t
  misc_feature (96346)..(96346): n is a, c, g, or t
  misc_feature (96348)..(96348): n is a, c, g, or t
  misc_feature (96350)..(96355): n is a, c, g, or t
  misc_feature (96357)..(96361): n is a, c, g, or t
  misc_feature (96363)..(96363): n is a, c, g, or t
  misc_feature (96366)..(96367): n is a, c, g, or t
  misc_feature (96369)..(96372): n is a, c, g, or t
  misc_feature (96376)..(96380): n is a, c, g, or t
  misc_feature (96383)..(96386): n is a, c, g, or t
  misc_feature (96390)..(96396): n is a, c, g, or t
  misc_feature (96398)..(96399): n is a, c, g, or t
  misc_feature (96401)..(96402): n is a, c, g, or t
  misc_feature (96404)..(96404): n is a, c, g, or t
  misc_feature (96406)..(96410): n is a, c, g, or t
  misc_feature (96412)..(96415): n is a, c, g, or t
  misc_feature (96417)..(96417): n is a, c, g, or t
  misc_feature (96419)..(96432): n is a, c, g, or t
  misc_feature (96434)..(96434): n is a, c, g, or t
  misc_feature (96436)..(96438): n is a, c, g, or t
  misc_feature (96440)..(96440): n is a, c, g, or t
  misc_feature (96467)..(96467): n is a, c, g, or t
  misc_feature (96494)..(96494): n is a, c, g, or t
  misc_feature (96508)..(96509): n is a, c, g, or t
  misc_feature (96526)..(96526): n is a, c, g, or t
  misc_feature (96753)..(96753): n is a, c, g, or t
  misc_feature (97367)..(97367): n is a, c, g, or t
  misc_feature (97370)..(97370): n is a, c, g, or t
  misc_feature (97373)..(97373): n is a, c, g, or t
  misc_feature (98360)..(98360): n is a, c, g, or t
  misc_feature (98362)..(98362): n is a, c, g, or t
  misc_feature (98407)..(98407): n is a, c, g, or t
  misc_feature (98450)..(98450): n is a, c, g, or t
  misc_feature (98508)..(98508): n is a, c, g, or t
  misc_feature (98611)..(98611): n is a, c, g, or t
  misc_feature (98930)..(98930): n is a, c, g, or t
  misc_feature (98977)..(98977): n is a, c, g, or t
  misc_feature (98979)..(98979): n is a, c, g, or t
  misc_feature (99072)..(99072): n is a, c, g, or t
  misc_feature (99166)..(99166): n is a, c, g, or t
  misc_feature (99717)..(99717): n is a, c, g, or t
  misc_feature (100222)..(100222): n is a, c, g, or t
  misc_feature (100299)..(100299): n is a, c, g, or t
  misc_feature (100636)..(100636): n is a, c, g, or t
  misc_feature (101140)..(101140): n is a, c, g, or t
  misc_feature (101175)..(101175): n is a, c, g, or t
  misc_feature (101180)..(101180): n is a, c, g, or t
  misc_feature (101185)..(101185): n is a, c, g, or t
  misc_feature (101240)..(101240): n is a, c, g, or t
  misc_feature (101244)..(101244): n is a, c, g, or t
  misc_feature (101498)..(101498): n is a, c, g, or t
  misc_feature (101938)..(101938): n is a, c, g, or t
  misc_feature (102033)..(102033): n is a, c, g, or t
  misc_feature (102052)..(102052): n is a, c, g, or t
  misc_feature (102059)..(102059): n is a, c, g, or t
  misc_feature (102146)..(102146): n is a, c, g, or t
  misc_feature (102165)..(102165): n is a, c, g, or t
  misc_feature (102345)..(102345): n is a, c, g, or t
  misc_feature (102398)..(102398): n is a, c, g, or t
  misc_feature (102418)..(102418): n is a, c, g, or t
  misc_feature (103034)..(103034): n is a, c, g, or t
  misc_feature (103570)..(103570): n is a, c, g, or t
  misc_feature (103661)..(103661): n is a, c, g, or t
  misc_feature (104193)..(104193): n is a, c, g, or t
  misc_feature (104197)..(104197): n is a, c, g, or t
  misc_feature (104254)..(104254): n is a, c, g, or t
  misc_feature (104387)..(104387): n is a, c, g, or t
  misc_feature (104510)..(104510): n is a, c, g, or t
  misc_feature (104528)..(104528): n is a, c, g, or t
  misc_feature (104625)..(104625): n is a, c, g, or t
  misc_feature (104907)..(104907): n is a, c, g, or t
  misc_feature (105053)..(105053): n is a, c, g, or t
  misc_feature (105396)..(105396): n is a, c, g, or t
  misc_feature (105529)..(105529): n is a, c, g, or t
  misc_feature (105622)..(105622): n is a, c, g, or t
  misc_feature (105628)..(105628): n is a, c, g, or t
  misc_feature (105636)..(105636): n is a, c, g, or t
  misc_feature (105643)..(105643): n is a, c, g, or t
  misc_feature (106058)..(106058): n is a, c, g, or t
  misc_feature (106202)..(106202): n is a, c, g, or t
  misc_feature (106338)..(106338): n is a, c, g, or t
  misc_feature (106350)..(106350): n is a, c, g, or t
  misc_feature (106837)..(106837): n is a, c, g, or t
  misc_feature (107062)..(107062): n is a, c, g, or t
  misc_feature (107277)..(107277): n is a, c, g, or t
  misc_feature (107340)..(107340): n is a, c, g, or t
  misc_feature (107790)..(107790): n is a, c, g, or t
  misc_feature (108112)..(108113): n is a, c, g, or t
  misc_feature (108116)..(108117): n is a, c, g, or t
  misc_feature (108121)..(108122): n is a, c, g, or t
  misc_feature (108135)..(108135): n is a, c, g, or t
  misc_feature (108144)..(108145): n is a, c, g, or t
  misc_feature (108242)..(108242): n is a, c, g, or t
  misc_feature (108263)..(108263): n is a, c, g, or t
  misc_feature (108622)..(108622): n is a, c, g, or t
  misc_feature (108769)..(108769): n is a, c, g, or t
  misc_feature (108944)..(108944): n is a, c, g, or t
  misc_feature (108987)..(108987): n is a, c, g, or t
  misc_feature (109077)..(109077): n is a, c, g, or t
  misc_feature (109193)..(109193): n is a, c, g, or t
  misc_feature (109439)..(109439): n is a, c, g, or t
  misc_feature (109512)..(109512): n is a, c, g, or t
  misc_feature (109578)..(109578): n is a, c, g, or t
  misc_feature (109685)..(109685): n is a, c, g, or t
  misc_feature (109729)..(109729): n is a, c, g, or t
  misc_feature (109736)..(109736): n is a, c, g, or t
  misc_feature (109746)..(109746): n is a, c, g, or t
  misc_feature (109863)..(109863): n is a, c, g, or t
  misc_feature (109872)..(109872): n is a, c, g, or t
  misc_feature (109879)..(109879): n is a, c, g, or t
  misc_feature (109885)..(109885): n is a, c, g, or t
  misc_feature (109893)..(109893): n is a, c, g, or t
  misc_feature (109898)..(109898): n is a, c, g, or t
  misc_feature (109901)..(109901): n is a, c, g, or t
  misc_feature (109904)..(109904): n is a, c, g, or t
  misc_feature (109917)..(109918): n is a, c, g, or t
  misc_feature (109927)..(109927): n is a, c, g, or t
  misc_feature (109982)..(109982): n is a, c, g, or t
  misc_feature (110342)..(110342): n is a, c, g, or t
  misc_feature (110396)..(110396): n is a, c, g, or t
  misc_feature (110452)..(110452): n is a, c, g, or t
  misc_feature (110461)..(110461): n is a, c, g, or t
  misc_feature (110469)..(110469): n is a, c, g, or t
  misc_feature (110477)..(110477): n is a, c, g, or t
  misc_feature (110521)..(110521): n is a, c, g, or t
  misc_feature (110531)..(110531): n is a, c, g, or t
  misc_feature (110755)..(110755): n is a, c, g, or t
  misc_feature (110846)..(110846): n is a, c, g, or t
  misc_feature (111004)..(111004): n is a, c, g, or t
  misc_feature (111691)..(111691): n is a, c, g, or t
  misc_feature (111942)..(111942): n is a, c, g, or t
  misc_feature (112103)..(112103): n is a, c, g, or t
  misc_feature (112273)..(112273): n is a, c, g, or t
  misc_feature (112368)..(112369): n is a, c, g, or t
  misc_feature (112372)..(112384): n is a, c, g, or t
  misc_feature (112386)..(112390): n is a, c, g, or t
  misc_feature (112392)..(112403): n is a, c, g, or t
  misc_feature (112405)..(112406): n is a, c, g, or t
  misc_feature (112408)..(112414): n is a, c, g, or t
  misc_feature (112416)..(112419): n is a, c, g, or t
  misc_feature (112421)..(112436): n is a, c, g, or t
  misc_feature (112438)..(112444): n is a, c, g, or t
  misc_feature (112446)..(112450): n is a, c, g, or t
  misc_feature (112452)..(112469): n is a, c, g, or t
  misc_feature (112471)..(112471): n is a, c, g, or t
  misc_feature (112473)..(112475): n is a, c, g, or t
  misc_feature (112477)..(112482): n is a, c, g, or t
  misc_feature (112484)..(112486): n is a, c, g, or t
  misc_feature (112488)..(112488): n is a, c, g, or t
  misc_feature (112491)..(112493): n is a, c, g, or t
  misc_feature (112495)..(112496): n is a, c, g, or t
  misc_feature (112498)..(112501): n is a, c, g, or t
  misc_feature (112503)..(112503): n is a, c, g, or t
  misc_feature (112505)..(112508): n is a, c, g, or t
  misc_feature (112511)..(112517): n is a, c, g, or t
  misc_feature (112519)..(112522): n is a, c, g, or t
  misc_feature (112524)..(112524): n is a, c, g, or t
  misc_feature (112526)..(112531): n is a, c, g, or t
  misc_feature (112533)..(112534): n is a, c, g, or t
  misc_feature (112536)..(112540): n is a, c, g, or t
  misc_feature (112543)..(112550): n is a, c, g, or t
  misc_feature (112553)..(112554): n is a, c, g, or t
  misc_feature (112557)..(112561): n is a, c, g, or t
  misc_feature (112564)..(112564): n is a, c, g, or t
  misc_feature (112567)..(112571): n is a, c, g, or t
  misc_feature (112573)..(112576): n is a, c, g, or t
  misc_feature (112578)..(112580): n is a, c, g, or t
  misc_feature (112582)..(112590): n is a, c, g, or t
  misc_feature (112592)..(112596): n is a, c, g, or t
  misc_feature (112598)..(112598): n is a, c, g, or t
  misc_feature (112600)..(112602): n is a, c, g, or t
  misc_feature (112604)..(112604): n is a, c, g, or t
  misc_feature (112606)..(112617): n is a, c, g, or t
  misc_feature (112619)..(112621): n is a, c, g, or t
  misc_feature (112623)..(112627): n is a, c, g, or t
  misc_feature (112629)..(112632): n is a, c, g, or t
  misc_feature (112635)..(112638): n is a, c, g, or t
  misc_feature (112640)..(112645): n is a, c, g, or t
  misc_feature (112647)..(112653): n is a, c, g, or t
  misc_feature (112655)..(112659): n is a, c, g, or t
  misc_feature (112661)..(112662): n is a, c, g, or t
  misc_feature (112664)..(112699): n is a, c, g, or t
  misc_feature (112701)..(112721): n is a, c, g, or t
  misc_feature (112723)..(162722): n is a, c, g, or t
  misc_feature (203724)..(253723): n is a, c, g, or t
  misc_feature (279466)..(280211): n is a, c, g, or t
  misc_feature (281044)..(281143): n is a, c, g, or t
tacatgaaggaccaaatctaggagagtcagaagtgcgtcacaggaataggggaccttgagccagacagaaggctcagcagagacaccctcaaggggatgaaagggattgagtgcactaatatttagaggagagagttcaggacttgattagtgactagtacatagaaaactaaacaaatgaggctgggtgcagtggctcatgcctgtaatcccagcactttggggggccaaggcgggcgaatcacctgaggtcaggagttcgagaccagcctggccaacatggtgaaacctcgtctctactgaaaatacaaaaattagccgggcgtggtggcgggcgcctgtagtcccagctacttgggagcctgaggcaggagaatcgcttgaacctgggaggcggaggctgctgtgagccaagatggtgccattgcactccaccctgggtgacagagcaagactccgtctcaaaaaaaaaaaaaaagaaagaaaaaaccaagcaaatgaaaaaagaaggcaattaataattccaaagaaaagaaaaatttgggcagaaaagaacaaaacaagcagaatttaccatgactcagttctgaatacaaacacagacatcataatgtaaacaccaacactgatgcaaccagaatcatgggagaaaaanagatctagggagggtggtggacgggaatatcacgtatgtactgggggtaggggagagaacaaaatgggaaaaatcaagaataattcacgttagaaataaaaatacagagcaaaatttaaaaatgcaaagaatgaggtgaagagttcaaagtggtcanccntcggggccngggcgcggtggctcacgcctgtgatccnagcactctgggaggctgaggcgggcggatcacaaggccaggagtttgagaccatcctggctaacaaggagaaaccccatctctactaaaaattagccaggcgtggtggtgggcgccngtagtcccagctactcgggaggctgaggcaggagaatggcgtgaacccaggaggcgcagcttgcagtgagccgagatcgcgccactgcactccagcttgggcaacagagtgagactccgcctcaaacaaaacaaaacaaaacaaaaaaacaaagtggtcatctctaggcaaggtgggtgggagatggctagggctgcaggtccactacgtgagctggctcagcctatccccagacaccctgcactcactcagcccggggtcctccccctgcactcactcagccccgggtcctcccctgcactcactcagccccgggtcctccccctgcactcactcagccccgggtcctcccctgcctgctctttctctgaccctgccctccactgttcctttttcttctttctctnccctgttgtgtccaggaaccaggcaccaccctcatttcttctntgatcaatctttaaaaaccagcagtgctcagctaactcttcatctatctcccccgacctggggctctgctgaatccacngctttagacccagctatcagctcggcatgtacagctggatgtccacaccgagctgctcaccctgtccccagcttcttcctcccactgtccactgcagaagcctcctaacaggacccctgctgctaccccggaccctgcaacccattcccacacagcagccagatgctttgacacccgaagtctcctatgaatccgatgaggcctctgcaccacancctcanttttacagaagtacaggggaaacaggggtctgttgacaccacagagatgcagctggccaaaggcagaantgtggggtacacgactgtcaaacgccaggggtccttacacgaatggtggaaaaaganggggcatgttacggatggaggctcgggacacatgggcgccgccttcccatgctgccagcaacccaccaggnaacctattaatttagtcatttgggaaatgggagctgggtatatcggctattaggaaattgttcatgctcaataagtattaattacaattttcataagagcttaacccccctgaaagaggtcactgtttcctcacttgtaaattgggatactaaaacctgccccatggagttgccagagtgacgtgtgtgcgtgcacaccaacagtacacagcagatagtgacatatgtgtgcacgccaacactacacagcagatagtgacttgtgcgtgcgcgccaacactacacagcagtgacacgtgcgtgcacaccaacagtacccagcagatagtgacatgtgtgcacgccaacactacacagcagatagtgacttgtgcgtgcacgccaacactacacagcagatagtgacatgtgcgtgcacgccaacactacacagcagatagtgacgtgtgtgcacgccactacacagcatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacactacacggcagatagtgacttgtgtgtgcacgccaacagtacacagcagatagtgacatatgtgtgcacgccaacactacacggnagatagtgatgtgtgtgcacaccaacactacacagcagatagtgacatgcgcgtgcacgccaacactacacagcaggtagtgacatgtgtgtgcacaccaacagtacacagcagatagtgacatgcgcgtgcacaccaacactacacagcagatagtgatgtgtgtgcacaccaacagtacacagcagattgtgatgtgtgtatgcacaccaacggtacaacacgcaacagttgcagttgcctcatttccncaagtcgccctcactgcagaaaggggagtgtctccagctgcttagtccagcagcctccaggattgggtgagggtcggagggccctggtgccctgcatggacaaggcagtggcagcagggctgaaggacaggctggggtgggaggaccgcaaccctctgggatcgggccccacggtcagctcccgcagcccaggggagaggtgcccactctagcagccctttatgtgctcctcaagctganaagtagagaccccgctttgtgactacagtgagttctcacaccattaggcgaatggctggngtaagaccaccctgtggcccctgcagagctgacctcactgggtggtccaccgaagaggggatgggagggcaagtttnnnnnnngnnnnnnnnncngnnnncnnnnnnnncncntnnnnngcncncnngtaggttaggcccccntctnccgcgtcccctncccctcctcaccccaatncccatcccccacgcggtgcatcgggtgaaggggtggggnnnnnnncancacnnnnggctcagngctncccacagnctcntaccctcntgcccagcangtgcnntgnccagnccggncccctcctctgaagggtncttggcagaangatctccaaatngaaggtttctggtggcaggcccaggtgctggggccatacctgggggagctccaccccccggctgtaggtaggcaaggcccggattccagggnccagtgtaagatgacccaggtgagcccaaatcaggtccatctcttaacacaaggagctccctcggcacctcctgtgtgctacacaggggtcccagcacccatgcaggggagaggcctttggatcaccacagcccacactctgtacagagggataaactactgctttgcctgtagagtagccattcttttatttatttttttctttttcttttttttttttttttttttgagacgngagtcttgctctgttgcccaggccggagtgcagtggcgcaatctcagctcactgcaacctccgcctcccgggttcaagtgattctcctgcctcagcttcccgagtaactgggattataggtgcctgccaccacacccagctaatttttatgtttttagtagagacggggtttcaccgtgttagccaggatagtctcaatctcctgaccttgtgatccacccgcctcagcctcccaaagcgatggaatcacaggcgtgaaccaccgcacccggccctaacttttctatttttagtagaaatggggtttcaccatattggccaggttggtctcaaactcctgaccttgtgatccgcccgcctcagcctcccaaagtgctggaattacaggcgtgaaccaccgcacctggccccttttctttaataaatttgcttaaaaaaaaaaaagaacccanaggctgggcacggntggcttacgcctgtaatcccagcactttgggaggccgaggagggtggatcacaaggtcaggagagtggctaacacggtgaaacccntgtctctactaaaaatacaaaaagtcagccgggcatggtggcgctcgcctgtagtctcagctactcgggaggttgaggcaggagaatcgcttgaacccaggaggtggaggttgcagtaagccaagctcacaccattgcactccagcctgggtgacagagcaagactnctgtcntcaaaaacaaacaaacaaacaaacaaacacaccaaaaaccagaaaacccagaggggtaaattgaggcaggctggccgtgtgccaggccccagactgcagagcccagactccccaccgaaggctgagggtcgcgcttgctgtgtgaggctcagcaccttngtcaangtgcacccnacacggtgactcgtgggggtagcagcaccaagcactgcgccacccatgatgtagtcatcaccacctgaagaaaccaaggctgactccaacctgctcacagccacggtgtagcaatggcctggccagggnctcaagcccacccctcctcctcctgggaatctgggaaccccatgtttgagtgggccccccactgcaggacctctgctggcccttgcagctaccactgtacagaaggtgcacagggcagggccttgtccccaagaggctcggtgagtggaaggcacatggcatgaggaccgctgtgagccgcccgcccctcatccccgtggtggtgttccccaggctgcatcggctcaacagggggaggcagcctgggtcaccctagcctggtgggcactcgaaacgctcctcgaaggactcacaggccccatgggggccaggtaaggccgtgtgtttacagggagttggctcggggctgggtactgctgtgcacactggctgccaggcggcagctgggctggtttattactggaacaccctccccntgctcnctcctccccggggaggccagccctgcgccagcatctcnctgcaccagcccacccaccaggaggcgccntgtggggccactcttctgggaaagcgtngttcctggaataaattctggtttcgcttccaacaggaacaggaatagagctccctgtctggcctgccagggcagcttgcaggtttgaaggtcaagtgcacgtggctctctcctgggcccagcggcacccccttcttctggacaggggaggagccagctcctagaggggccacagtgccccagagggtgggttcagggtggtgcctactacctctgcggccccctgggcagcccctgtggcagaacaagggtagtgatatcaggcagcccagcctctccctccagaatgccctccctgccaccacctgccctaggagacctgagcacgcccagtggcttagactgagaatttctgggcttgagaagccttcgccatgatctggggtttccagccctgcccgggagctggctgtgcatgtgtgccgcaggggcagaggcctgacagaccaccaagaggccacgcccagtgccgccgcctttattcacagaccctcgagctccacagccacacagacacttagctttcagagggcacaggaaggaaaagggacctggtgaccctcccagcacaccccagagccaagacagacccagcagcagcacctcagggtcagcctgggtgcccctgcccaggggccactgtgaccgcagacaccaggaggccaggcctggttgctggggacccccttggggggcccggcagtatcctaggcccaaagagctggtgccatcttgaagctgattcagggaangaggccaggctggacggtaggggtaggtgtgagaagctccccagcgtgtccaggccacgggagcagcaagggtctgcggggagccnaggctggatggggtggggctgcccttgtcctgtatcctgaccacttcaaggacaaaaccagcccagtcccagcagcntgggaggcagcagaggctcnttcttctcccctcctgatcctgcagtggccaggggcaggagggtgaggggagaggagagaggtcagngtcagggcccctgggggccaggcagcttcaaaaatgcagccaggtggctgggggagggcaggagggtgggcagggcccagacccccatgatgggggcagcctgagacccccaaggatgaaggaagggggcttgggaaggagaggcaggcctcagccgtcagtcacgccagtgctgggatctgcagcccgctggagcaaggcacccccatcccaggggcaggnaccacaggacaggagggaaccgacacctcgcaccctgatcttccggaggccggggaggggcaccgggcgctctaggacttcttggcatcctgcgtgctccggcgcttcanggtcactcaggtcgatgggctngaaggctgccaggggacaacgcggtaggntggtgggcacaggcccctcctgcccatgaggcccggcctgccggcccagccctgcccccaggtcagcccccactcactcttcaggctggggttagggaccttctccacatactcctccaccaggccccgctcgccacccggcacctggcctcgcaggtctcgctccacaccctgccaggctgcagaggcagagagtggtgtgctcagggccccctgccccagggggtggcatccacgtcacgagagtgcctgccctcagctcctgccctcccagatcctcttctccctcagaagtgtcctccatgctcccccacagccctctgncccaccccagcctcactcacctgcagaccccgtccccgctcctctggcaggcctgtcccttccccgcaagatgaccaggactgtggtcagagggacccctatgaccctaccccaggcttccctgcgcctcggaggcagcgcatcctcctcagctaggcctctatctttcccacctcatccacgcacctccccggccccagcacacggcacactcccctaatcccagacaaccacctcccggccacttctgcaacacgcccgttcatggctggatgcgtgcctgtctgtcttcaaagngcccctccctttccccagcaaactcctccagtgctgctagcatggatgactggctcccagtgcggcctctatctgtggcatggcccacccccagcccctcctcccgggctccccccatgatcagaaccaggtctcctctctacacaaggtcccctcggccacccctacccgcctgggccctgaaggctgtggacacagtgatggggctatctgtgccctggaggggcaggggcaggggccgcaggaggttcctcggagcgtgggtcctgggctgggggcagagctgactccgtcaaggacagggcaggagctgtgtgtggcaggcgcacccaccttcgtaaatgaagcggacgttctcctcgtgggctggggtgaagatctcgnctgctgctgggtggggagcgggggctgctggtcctcttgccgttgtacacgactctggagacgggggnagctgggggagcctggcgcatgagacagggcacacagcagggtgggagcccacaacccgccccggtggagaccagcccacctgcctgagacccacctggtcatcgcgggggcgtctgatcctagcgctccaccgccagatcccctcagcctctgaaacagaagccagcgcaggcatgggacgcagggccaccctctccagcacagaaggagggggaggcgcagggcacacctgcctcctncccnttcagatgtgaacaaagtgcatggtccctctgcctaccagggtgtcccccacaggctggggtccagccacaggcagccagtgggctccaggcaaccctacgaggtagcagagagctggccagacgagccagacacacacacaacttgaagcgatcaagcccgctcagcggccttgatcctccacgtctcaggctcagacgtggaggcctcagccccagcaccgggagcactgtggccagagccncctccccacgtngggctggtggggccgtcagcatctctgatgtccagctgcctctcactgcagcagagggcctgcagcccctcagctaactgaccctgctctccctggtgcagggctgggcacacggcttctgctgagccttgatttcctttctgtaaaacggggatgagcttcctaaaggtgatcccagctnccccggcacctacccaggtccagcttcctggttccctagagcatgagccacatcagtaccctggagatggaaccaaactccagctcccctggtgggcagagggggtggccctggaggaagctgctgggcctgacctggtgaccaagaccctgggctgccgcccgtttatggcctcccagcccaggggaatccacggctctggaaaaatggagtctattttgaggctcagacgctcacactgngcaggctggacagtgtccccactccagctgaggacacacananccccaaggntggggaagctgacagggnctggtctccagcctgccctgctccagangggggcaactccaggttctgggggaggggagtcccaggattcccaggagggggctttgagcacaagcaactcccctgcccacccagaggcccaaggctgcagatactccagggcacacggctgcagccctcacagagggccaggagcactgaggcttcgagtcctcntctggctcattccgcctcatgtcaatggtccagccctcaaacaccacgtgataagaatcccacggctcaagggcaaaaccnagcaaagagcagaaaaccagctcccagccctggaactctgtgccccatcccaggccaggagtgaggtccaaaaagggccaggggctccccacccacggcagcacccagtttgctcacaaagtcacctctcctttcttggactctggggtctctctgcccagtcnctcctgccagggactccagcccacgaacaccagnagcacggagnggaaaggcctgtttgggttgagggtcccacagggacatgctgcctgctgggaagctcccgttacagagaaaggcagagctcaggtaacaggtagactggccagccccctgcctcgccccctgctggctctcaccactgaccgactgctgctttaggggtacctgcctcccagncctgccctctcccgtggctcttctccccatgcatcctctgcctccagtggccacttggcctttatgcagccacacctttggcctgggatccccctgctgggttcggttgtcactcctgccccagatcccactgattgccccacatcctcccaagcaactacccttccggggctccctttgccttgtgtgcacacacacacacacacacacacctgcccacacatacctacctgcacacaccttagctgaatacatctgccancacacatgcatacaaccgcccgcacacacctgtctgtacacacctgcccacacacatgcggcacacacccatatgaacacacctggtgtggcagcatgcacttgtagtcccagctactcagaggctggggtgggaggactgcttgagcccaggaggtcaaggctgcagggagccaagatcgtggcactgcactccagncccaggcaacagagcnaangacnccntgtgtcaaaaaaaaaaaaaaagcccaggcacggtggctcacgcttgtaatcccaacactttgggaggcagaggcgggtggatcagctgaggtcaggagtttgagagcagcctggcgaancatggtgaaaccctgtctctactaaaaatacaaaanttagttngggcgtggtggcaggcacccgtaatcccagctactcgggaggctgaaacaggagaatcgcttgaacccggganggtggaggtgcagtgagccaagatcgcgccaacgcactccagcctgggcgacagagcaagactccatctcaaaaaaaaaaaaaaaaaaaaggccaggncgtggntggctcacgncctgtaatcccagcactttgggaggccgaggcgggtggatcacaaggtcagngagttcaagaccagcctggccaatatggtgaaaccctgtctctactaaaaatacaaaaattanctggatgtggtggtgggcacctgtggtcccagctactcangaggctgaggcaggagaagtgcttgaacctgggaggcggaggttgcagtgagccgagatcgtgccactgcactccagcttgggcgacagagcaagactccgtctaaaagaaaaaaaaaaaaagccaggtacggttgctggcctattaaaataggcctgtaatcccnacactttgggaggctaaagagggcanatcacttgagcccnagagttcnaaaccagcctgggcaacatggcaaaatcccatttcttttatttatttatttatttatttatttgagatggagtctcgctctgctgcccaggctggagtgcagtggcgccatcttggctcactgcaagctccgcctcccgggttcacgccattctcccgcctcagcctcccaagtggctgggactacagaagcccgccaccacgcccagctaattttttgtattattagtagagacgggatttcgtcctgttagccaggatggtctcgatctcctgaccttgtgatccacccacctgggcctcccaaagtgctgggattacagtcgntgagccaccacgcccggccggcaaaatcccatttctacaaaaatataaaaactttggcaggagtgatggctgaggtggtaggattgcttgagcttgggaggtggaggctgtggtgagccatgatcataccactgcactccagcctgggtgacagagggagactctgtctctaagtaaataaatttaaaaccccataaatatatacacctattgtgcacccatacattttttttttttttttttttttgagatggagtctcgctctgtcgtccagggtggagtgcagtggcgcgatcttggctcactgcaagctccgcnctcccngggttgnacgccattctcctgcctcagcctctcgagtcgctgggactataggcgcccgccaccacgcccagctaattttttctatttttagtggagatggggtttcactgtgttagtcaggatggtctcgatctcctgacctcgtgatccatctgcttcggcctcccaaangntgctgagattacaggtgtgagctaccacacncncagctgcacccatacagttttttaagtcaacaaggagtctcgtttgcctcctcttgttaggaaaagaaatgtacccacaccctcaataccacaggctgtgtcctctaagtcttcccagacacgaagagcccttcccacctctccctacttcttcctccagcttagggacccccagggcctcacactgcccccccaccccccgaccctgcacacatagccccaggctttcctggatgtgccagcagttccaagaggccaggggcctgctgtccccctggaagcacaataaacggttctgcagctcattcagcctcactgcctcctggggccctgccaaggagctgggtgcccaattctgacccagaaggaattttccattaaaaatcaagtatctgtgcacaacctatgacccagccattctgctcctaggtacacacacccaagatgcgtacaaggacagctggagaatttcactcgtaattacccaaagggaagagccaccgcagaagggtagcaatgcacacctggcctattcccataagggaatcagcagccagagggggcaccacagcccccacgcagagacggacaccaagcacaagagcaggacctgaggggccacagacaggccctgggacacatgnaatgggaggaagctgcanagggccgaggcatggacataactggagccggggccaggacggtgcctgtgagggcaggaaggagccatccacggagagggctggaggtcaagcaagctctgaaccaagaggtcaccatggagccacaataaggcctccaacaacctcagcggggcggcctagcatagtgaggcacacagctgaggggggagggcaggaagtgtggctnggcaggcagctcagccctagctcaggcctgntgggcagcaggctggtgtctggctaagcagagggaaccctgaggcacaacatccatgcatggggtccctgaggtggtggatgtggagggacccagganccatagtgggtgagagtgagcaggggacaatggcacaggcccagagaagcgccgggggcagccggaaaagacccagcacacggcagacggccacctgaggtggcagcccctgagccagcaggagactgacacctcagctgcccaggtaaaggggagtggcggcctgaccgaggccgaccacaggtgaagggtgggagggaggggctccattncnnngnnccagagagacagccccacttcagaggtctcgagaccccatccagcccggccccctgccttcatcccacctgggccaccaccagggtgacagcagtaagggagggtcaggcgatgcctcggtcccgttttccttccctctttctgtcagaatcaagaccgagcatgccgatgtcccggccacggccccgtactcctcagtcgctacaccacaccccactgcctctgagagttttctttcatagttttcatattttaacatctttgaaactgggctgcgcctgacaattgctaacacgtcagaatttaaccaatggtggtttttatttctcaatgtactgtaaaatatagcgcagctcacaatggctggggtctcacatgggaggaccctcgatgacactctcctggcccanggaccacccttccagagcccctcaggctacatggtctttaggtgttttctccccttcccctcaaagtcttccacatcccacgccaccccaccccacccagtgctgggacaacctccagttccagacacccagcatcaggacaggtggacacagatgtctacatgatcttcctgaaaccctatccccaagtcacttagcactagggtgtcacccaggccctctgctgccatcaangcccactgtccagtcccaacttgttttaccaggtgtcacctgctgctccactcctgccccaacagcctttgccacaggactacctgccaccagccacacagagcacaggccacctgcaagtctgtgcattctgcaggacgtgactgcctgcttccgtggccgtccagcctacagggcctggcctactgggctgcaggtattcccctgctctggggccccgggcaagctcctctgagcctcagcatcctcattcaaagtgatgcnagcccacaggtaggnctcgcctgctccaatagggacggaagcacagccatggaaagccagcagctcagtgaggtctctgtggctccnttatccnatacgatgatggacaggacaagcatgtgctgtatggttcaactggatgctgttaagaatgaaaggggctggggccaggcgtggtggctcacgcctgtaatcccagcacgttgggaggctgaggtgggcagatcacctaaggtcaggagttcgagaccagcctggccagcatggtgaaacccncgtctctactaaaaatacaaaaagtagccaggcgtggtggcagtcgcctgtaatcccagctactcaggaggctgcggcaggagaatcgcttgaaccncgggaggcagaggttgcagtgagccaagatcacgccattgcactccagcttgggggacaagagtgagacttcatctcaaaaaaagaaaaaagaaaggggctagatgtggtggtaatcctagcactttgggaggtcaggagttcaagactggcctgggcaacatagaaagagccccatctcgacncaggtgcggtgactcacgcctgtaatcctggcactctgggaggctgaggtgggcagatcataggaggtcaggagtttgagaccagcctgggcaacatggcaaaaccccattgctactaaaaaaaaanaaatacaaaaattaggccaggcgcagtggctcatgcctgtaatcccagcactttgggaggccaaggtggaaggatcatctgaggtcaggagttcgagaccagcctggccaacatacagtgaaaccccatctctactaaaaaaaaatacaaaaattagctgggcgtggtggcacatgcctgtagtcccagctacttgggaagctaaggcaggagaatcgcttgaacccaggaagcagaggttacagtgagccgagattgtgccactgcactccagcctgggcaacagagcaagactctgtctctcaaaaaaaaaaaaaaaattagccaggcatggtggtatgcacctgtaattccagcttctcaggagtctgaggcaggagaatcgctttatacccaggaggcgcaggttgcagtgagcagagaccatgtcactgcactccagcttgggaaacagagacagagcaagactctatctcaaaacaaacaacaaacaaacaaacaaaaaagggccccatctctgctctctgccctcaaaaaaaaaaaaaaaaaaaaagaacgaaagggatgctgttgattatcaagaatgaaacaactcttctgggtaaactggaatgtagagtcagcccactcttaggaaggtggaggcccagaaaagcactggggactgaaagaagagactgccaccagccacagcaaacacttgtcgggctaagggcagggcagccaccacgctgggcccttacacacattgcccacatccccacagctggaccagaaagataccctgagaacttccagttcagcgctgaaggagcctgccaccaagcagcggtgcccctcccagggcctccggggccacagcatttggggctcagcccgaatgctgcagctggcctgagcctcccaaagtctgcctccactcntgcctgcaccctancagcaggtttctggactccctgaaagacccactccctactgatacccatgtggctttgctcagagactggcccntccctccagatagggaggggagtcgcattgggtagaactatgtagaaccttcctcctccaggggacccaagggctttagagacttccaggtggggaggggacagaaccccagtctctggcctcccagtcccaaattctttcccccacacagccacatgcctaagaacaggccatgaggtaacactccagcaacgtgacaatagtgaggttccagagttagaatcagtgacgccatcgctagtcaccatgctcctccggagtttctgagattcaaagtttctaagactccactttctcttcgtgttntgtgtctttttcagccaacgaggctagaaaatgatctattgcccaagcaggcgcacgaggatacggntgtcacagctgccacactggcacctcgtggtcccttgaagaccgcccagggaaagcctctaagcgctgcaccacctcctcaccctctcccctgggtggtggcagcaacagcctgagcgtgtgcgccctcctccccatcctgatcccactcaaaccacaacctcccntgactcgccccaaatccagccctgttggctcttccttcacgtcccacttcccaccctctctacacgttctcgccacatcccacccaaagtccactcactggtccctgtttacacctcagggcctttggtcaagctgtcttctctgcccaaaactatcctactcatccttggggatccagctgaaagaccancttccngcgacngctacccangggcaggagggagagaagcacagcccgtgccccgtatggctcccgcccccgcggtcacaaccaccgcccagtgagtgcctanaaggcaggcggaggccccgttctccccgttaggcccagcatcaccgcccggggagacgggaaagagggcaaggccnaaaaatggacagaaaaagaatgcggacggccgggcccgcggcgctccgagaatcggaggcatcctcaggnacggtccctccaggagaccgggaaagcggggctctgtcagccccnaagccccgacggcggcagaaggctggcccgctgcgagcgtccggcggcgctgggtccccggcacctgcccctgcctgggcgggaaaggcgctcagtccgagccgcgccctccccacgcgcgctcccaggcgccccgcgggccgcgccctcctgcaggtgccgggcggggaacgcgggcccctccctcggaccccggctgcccggccactcccccgcgcncggncccgcccggccctgcanggnacccgcggccgcgcggcgacaccanggcggggnccagncgngnccgncnngnnnnntnnngnntcnngnnnnnngngnngntnnnnnnnnnnnngnnncnnnancnnnnngnnnnnnnnnntncnntnnnnngnnccnncnnnnngnnnacnccncnggnnnnnnnngnncnnnncnntnnntnnnncnttnanannnnnnntnnaananggnnnanncgnnnncnnnncctnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacacatccctgtagaccattgactggcccataggagtcttagagcggaattaaggctccgattattcctcctttcgtcggagcagcagtatctgagaagagaggaaggcacttccctcccaaaggccctcctagagtgatctggagaacggcgacgggggaagtctcagaaatcacaggcatggtcaggcagggtcccgaggataagagcggcatagtggggaagaggtaggcaccgtagcctgcttctcagcggaacagtcccgcgtggctcgagtgggccggcggatgatgcccggccacctcagagtgcctcagcggtaaagtcgtccactacgagcatatgagtgtctcgagaggccttggagacaccgggggacacgcgccctccgctagttgcagagggcggtccgcgcgcccatgcctgtgatcccgccttgcggaacagtccgaaggggcctcccccgcccggccgagcagtgcagctgaggccgcgcggcgaccagagggcgggggccatccgcgcctgccaggccccgggtcttccggggccaacgggcgctgcacgaggatcaccttgccctgtccaggccgccaccgcctcttnnngntnngnnnnnnngnnngnagtgnngccaccgngggctgcacaggngcaggcgcagcgcnntctcacgtgnccgcccggctggcggagggcgggggcggccgggattcccgtgcggggttggggctcgtggcggaagctccggacctccctggcccgaacggtgagcgccgccgnccactgggagcggccagagcccagtaatcaggacaccaccacagggaccacgtgtgtagacccaggccccctcacctgggagtcacgtttattgaaaaagtaaaaagtgtcacagtaaaaaattcacctggggacaaagccaggcctaggaggggtggcggggtcgtggagggacgggtccggccgcccctggcccacgggtggggcacgtgctggcccatgggcgacgcgcggcttctccagggaggcggccctgggcgcgggggcgggcgggcaaagctggctcagtccatcgtggtccctttgaagagctccaccagctccttgtagtccgggtcgatgaggtcggagggcaggtcgccatcgtcgttggttgcatccctgtccgctcccagggagataaggtacctggggtgtaaaggtcgctctggctgaagcggggaggagccaggagagtgctcgccccaacccgggtcagagggccagagtcctggggtcacctgtgtgtcccccaccttggggtcctaaggtccgggtagggtgaggaggaagaaacctgaccctttggaagctgtggccagcttttcaagttggttctattgaggacaaaggcagaaacaggattccagaagcctctagggtttgcagggttcntttttttgttttttttgttttttgagacnagaatttcgctctntatcacccanggnctggagtgcaatggcatgatctcgactcacggcaacctccacttcccgggttcaagtgattctcctgcctcagccttgagtagctgggattacaggcgcgcgccaccacgcgtggctaattttgtatttttagtagtgagagggttcttgtcacgaactcctgaccntcaggtgatccgcccacctcggcctcccaaagtgctgggattacaggcgcaggcgtgagccaccgcccccagcctctagggttcttgccgacaccacccgggctacattttggggctcccatcctggggacccactgaggcccggaggggtcgggttcaagcctgtgtagacccagggccccctcacctggctatgtcagggtacccatcgctgncaggcaatgtgcaggggtgtccagcccgcctcatctcgctggtgaatgtcagccccgtatttgaccagcagcttcacgcattccnanggttnccagagagcacggcttcatgcaangcngccaggcctgggcagggaggacgggaggggtcaagactnngccccaggtcaggtcctccttgctggcctctcccaccaccccacaggccctggccagctcttccaggctttgctcacctgaggggtggatggtggccagggagactttccgagtccggatgaagcgccccacctgctccaggtcaccctgccggatgtggtccaagaacaggacatcattagggaaacgcacgctgcgatcagccagcatccgccgccgccgctgccgtgggctgtagcgggcatagcgggcagttctgctaggcatcttgggcgctgtggggcaggttgcccctggggaccctactgcactggggttaataatgtatccggtcccgaccagatcagcttgagggctcctgtcggacgagccccggcctctgacttgcttatatagggctcaggggctatataaagctgcacggtcatcctccccggcgcgaggggctgaaactgagctgcacccccgccccgcaccccagatcatgtttagtgactcatctttcagcccatctgtcaccgtgcccggccaaaggggtcagatcattcctgcctgtcgctccctgccccacagnctggacctagaaggtgccttaccgagggcaggaggaggcaccggtgcagaacccatgagatagctaggaacgcgagatcaagggcacagtaggtaccaaggtcattggaagggcttttgctctctacctcctggaaagtgaggggcggccnaccccctccacatctgcagaagcacaggtccaccgtgctgtggtgaaacaggccttagcccctccatctcccntacctgtcnagttttcaccttccagcgtggcttgcctcactctcagtggttttcccaaaactactctgatggcctaggcaggcggatcatgaggtcaggagatcgagaccatcctggnctaacacggtgaaaccccgtctctactaaatatacaaaaaattagccgggcgtgatggcgggcgcctatagtcccagctacttgggaggctggggcaggagaatggcgtgaacccgggagngcggaggttgcagtgagccgagatcgtgccactgcactccagcctgggcgacagagcaagactctgtctcaaaaaaaaaanaaaaaaaaaaaaaaatgactctgatggtgctgcctcctgctcagaaaccccgcaggcatccttggctgggatctcagtgcctcaggctcctgctcagtcagtcctgcgacttttcctccacgtgcctggntcccctgcctcacacacctgcaggggacagggtattccctacacactcatgggttcaccctgcatagtgtctctgcattccaggtttgacacacatactcacacttaaggtggtgtccagtttgctctccacgttcagggaccatcacaccctgggtggtgtgctctctctgccccggcccctgtgatcttacctctagangcacagccaagggaatttttttgtttgtttgtttgagtcagagtctcactctgtcgcccaagctggactacattggcgcaacctcggttcactgcaacctctgcgtcccgggttcaagtaattattttgcctcaccttctcgagtagctgggactacaggggcatgcaccaccacgtctggctaatttttgtatttttagtagagacggggtttcaccatattggccaggctggtctcaaactcctggccttgtgatccgcccgcctcggcctcccaaagtgctgggattacagacgtgagccactgcgcccagccaagggaatttttaaaactcgtgttccaacaggctcttcattgctggctgcctttacttttgcaacagccccagtggaggtccaaagtagggcttggactacaggacatgagnaagtggatgggatgggacacagacacagagttgaccagggaggtctttgttgtcagggacagcgatcgattgtgctaggagcactgcagcacttgaagctggatggatgagtctgccggggctgtcttcacagaccacagantgagtggcttaaaaaacagatggttggccaggcgtggtggctcaaccctgtaatcccagcactttgggaggccgaggcaggtggatcacctgaggtcaggtgttcgagaccagcctgaccaacaaggtgaaaccccttctctactaaaaaatacaaaaattaggccgggcacggtggctcatgcctgtaatcccagcactttgagaagccgaggcgggtggatcacgaggtcaggagattgagaccatcctggctaacacagtgaaaccccgtctctactaaaaatncaaaaaaaaaaaaaaaaaattagccgggcgtggtggcgggcgcctgtagtcccagctactcaggaggctgaagcaggagaatggcgtgaacccgggaggtggagcttgcagtgagccgagatcgtgccactgcactccagcctgggtgacagagcaagactccatctcaaaaaaaaaggccaagcgcgttggcttacgncctgtaatcccaacactttgggaggccanggcaggtgnatncacgaggtcaggagatcgagaccatctggctaacacggtgaaaccccatctctactnaaaaatacaaaaaattttctgggcatggtggcaggcgcctatagtcccagctacttgggaggctgaggcaggagaatggcgtgaacctgggaggcagagcttgcagtgagccaagatcgcgccantgcactccagcctgggcgacagagcgagactctgtctcgggnaaaaaaaatacaaaaattagctgggtgtggtggcaggcgcctctagtcccagctactcgggaggctgaggcaggagaattgcttgaacccaggaggtggaggttgcagtgaactgacatcacaccactgcactacagcctggggatggagcaagactccgtctcaaaaaaaaaaaaaaaaaaaagacggtccgtcccagagctctggaggctgaaatctgggatccgggtttcagcagggcaggttcctcctgaggctctgaggagcgtctgtcgcaagcctctccccagcttctggtgccgccagcaatcctggtgtccttggccctagcagcatcgccacgatctcggccttcatctccatggtgttctcccagcctttgtcactgttcacatcacccccttgtataaggacaccagttatagttgggtattgcctcatcttaaccagtgacatctgcaagcatcctgntttccnaacaacggtcacattctgaggtcttgagggctaggacttcanacgttaattaaggagacacatgagtcaacccataatgctggtaaaaccctgcaggtggtcactaaaggcctgaatgaggacagaaccaagactggccagcagctctttgcaggggcagaggagagctgggccaccaacagcctcgcatcattaggctgatctgcatccaacgaaatcaaatcagcaaacatattagacacctctaggtgcaaagccttggccaaatgctatgggagggctgggcacagtggctcatgcctgtaatcccagcactttgggaagccaaggctggagggtcagttgaagcgaggggtttaagcagcctgggcaacatagtgagactccntttgctttaaaaaaatttaaaactggccgggtgcagtggctcacacctgtaatcccagcactttgggaggccgaggagggtggatcacgtgaggccaggagttcgagatcagtctggacaacatggnagaaaccccccgtctctgctaaaaatacaaaaattagccgnatgtgngcggcgtgcgcctgtaatcccagctactcaggaggctgaggcagtagaatctcttgaacccgggaggcggaggttgcagtgagccaagatcgcgcgactgcactccagccntgggcgacagagcaagactccatcttaaaaataataataataaaaaatttaaaaaataaaataaaaagagtaaaaggaaaaatgctgctggagaagcggcgctgacggagggtccctgcctggcgaaatttcctggacctgcgttggtacccaggtgcaccccctgtcccctcccctgccccctgggcccctcgcctcgggtacaccacctctccagtcacacactggagtggccctggagcctctagccaggcccgggcctgcagacaccctgaggggggtcggctcccagcgtggctgcatttctagggactcagggaaaggtatggacagttggaattccaggtcacttgggaggagccaggccgttttttctggcttgtttacgtgaagcctggagacgaaacgttgtacactggagacaggctctcctctgatgtgaagattgccttttctcatgttgtggaaagttctgtctgccctcccccctcagaggatcagatgaaagcacgctggatgaagctgccaccaacagtgtgacgagaaggaacgccctttccaggagtgaccgggcctcaggctagagacgcggtgggggcaagaccacccggtgagcctgtttggcgaccccaagcaagcccctgtgtccctcctgctggaggtgagctgggagcgtgcagagcttttggctttggggtttctatctggatcacccgagggactggtgcctgaagcctcgccagtcacaacagatttccttgaaaggtatttatgtgccttctattctaataaggatgtgggaaccgtgtgttctacgccatgatagacactccctggagctcctcacccttgaaacgttccatcagaagccggccgtcagcagtcgtgcctgctccaccgtgggcgaagcgtgctgttcatgcagcgtgacgtcagagccaaacctgtcttcatggagttttgtccctgattncttcttggtccatatgaacttgcaaattgacctagtttgcatgactctaagtttctgccttctggaggacgaactagaacatctgatgcacaaggtttaccatcnnantttntntattttttttnnnagacggagtctcgctccgtcgcccaggctggactgcagtggtgcgatctgggctcacggcaagcttcgcctcccgggttcangncattntcccnnctcagcctccngngtagctgggactacaggcgccngnccaccacgnccagctaattttttgtattttnngnagnangacggggtttcnctgtgttagccaggatngtctctatctcctgaccncgtgatccgcccgcgtcggcctcccagagtgctgggattacaggcgtgagccaccgcgcccggcctaccgtccaacttttagaagtccagtgaggcctggctgggctcagaagctcacgcctgtaatcccagcactttgggaggccaaggtagaaggatcacttgaagccaggagttgaagaccagcctgggcaacatagggagacccccttcccttcaaaaaatttaaaaattagccaggcatggtactgggtgcctatggtcccagctacttagaatgctgaggtgcaaaagattgcttgagcccaggagtttgaggctgcagtgagctacngtcncnccantgcaccccagcctgggcaacagagcaagaccctgtctcaaaanaaaaaaaatgtncngtgaatgcanccagcagtgctctgcaaaagcacccgggagaccctgttagtaaagtcagctgaggccaggcgcagtggctcangcctgtaatcccagtactctgggaggccaaggtgggtggatcaccngagatcaggagttcgagaccagcctggcnancatggtgaaaccccatctctactgaaaatacaaagattagccgggcatggtggtgcatgcttgtaatcgcagctactcaggaggctgaggcaggagaatcacctgagcccaggangcagaggnttgcagggagctgagatcgcagcgctgactccagcctgggcaacagagtgagactatgtctcaaaaaaaaaaaaggaaaagtcagcgcaggtcgcactgcagtctggcaggagggccagcctagggccagaagggcccttccctccctgagngtcagaggccccccggggtgtggtacatagacccagcaatcactgttttaggctccaggccggtggcttcctggcacctggagagacagagggttgggaagtcccaggctgctaagccctaaccnacctcctcccagagccttcaaagtctccccactaatccagcagcccagtcagagaggttttggacactgccccaccacctcccagccacagccgagcccaggaatgtgctcatcagctgcctctgcaaaacgggaaaggtatcagtgactccctcccctttccagagcacatgacaccagtgctgcgggcagctgtgccatgtcccaacgnttctctccagagggccggctccccgcacagctggtccacagggtcactgcaccccatcccnacggccagggagcacaggcacaaatacagcccacccctttagctgtgactcaggacagcctccctcagagaccctgcaaggagccacagccctcgggcctctgcccacatcctcccacggcacctccagatgccgttgcccacttttccgtgagtacgcggctcactgtgtcgcaggacccaggcatggcacacaaaccctgctgaggccctggagctgaactagccnagaaaccagccccagcacgggctgtctccaagacccacagagctgggggccggggcagacggcagcacccagactgccgagctggtgtgagccgtgtggggccaaggacatgtgggcaaaccngggctggctggtgctggcgacgtgttgacacaggtcctcgcggcatgctggccggatactccacagcctggagcagaggcaggaggagccggagcggccgagtttgtgagggcctgtggggccggcaagggaggtagcggggagaacgggagaaccgcacccccggcgaggcctggtctggcttgagagccgtctctggctccagcagctgcagccagcccgcnaangctcgggaactgggaggacacccgggaantctcggcagtgcggaagctcctactctaggaagcacatcaggatgtgaagttggcggggctcacagagtcacaggcagggctcnctcaaggcagcctggtgagggtcgtttgttccatccgaacttctgagggccgagcagcctccctagagctgcagctccacccccnacntncccacctgccacctgcacccttgggctccttcctcctgcctcaccgccctctgagaccaccatgagccctgctggatcctcagggcctctgccgttgccctcagggggacccacagacaccacagagctcctgttgcctcccctgcagaaaagcagcaaatccaggctcagcagagccatcgcccagccctgcacacaggccgcggcttgccgtctgcagaaaaattgactttcagccgggcgcggtggctcacgcctataatcccagcactttgggaggccgacgcgggcaaatcacgaggtcagccagcagatcctggctaacacagtgaaaccccatctctactaaaagtacaaaaaattagccgggcgtggtggcggatgtctgtaatcccagctactcaggagngctcangngcaggagaatcacttgaacccngggaggcggaggttgcagtgagccaagacagcaccattgcactccagcctgggccacagagcaaganctccgtctcaaaaaaaatcgagtgtatgtgttttttctgcatgtgaagcacaggagtgctgaggttaagccaaattnacaacttaaagaccaggagatccttatttttagagacagctctgtcacccagctggagtgcagtggcgcgatctccgctcactgcagtgttgacctcctgggatcaagtgatcctcctgcctncagcctcccgagtagctgggactgtaggtgcaaaccatgcccagctaatttctaatttttcctagagacggggtctccccgtgttgccccagcactgggattccaggcgcgcgtccctgcgcccagccctgccctttatcgtgtgaagggttagtgataagcagggccccctgttcctctcacccatccttgaagcctgagtccacctgatttctcgtcactccacggcggggatgggagggaatgaccaggagtctgagcatcacatggggctgggtggctccacnccgtgtccacatccnagggtccagaatcacagaagccccatcagagtccaggtaaagcagcctacaggncagggaaggcatcctccccngggaantcgcaagcctgcacagctctgctggggagactggggcctgtttctgcatctgcacctcgtcccaggggcgaggcctctcagcaccagtaaccccactaaggcctggcagatggccttggcgtccgcattccagcccagctctccgggcttggtgagatcataaacccgaggcaaggacaggtggtaaaatttcaactttatttggccaatgtgttcaattcgattgtgaaatagaaatgcctgaagaactgtcagcgtctgattcagctccagcatccttggccacctccccacccgggagtcaagggtcgtggttctgccttgaacaggccacaggccgtgctgtagagaggccagtggtcacaatgagcccacgacaggaggaggagccctggcttgagggaaggggaaggcccaggcctgtgccgggccccagggctggcagccaccagcntcctcttccaggcatgggggacaccctgacaggatccggaagtctccatttacccaaaaatgcaagagccatgatcagtcatggcgacactgcaggcggtactgagtgaccatgtccagtccggctccgtccctcccacacgggggacaagcttctccgaggaggcctggccaaggtggaacaaataccctgatgtcgaaaaatgtctaaaaatcccacagacggaattttcaaaaagaggaganaacctcccgcgggagggaggcagcgagactccgaacacgngtagcaagcactctggacagactcatgtatgaaaaagtacatcatggtttcaggaaacaagccccaccagggtgggctgcctggagatggatccctttccaaaaaccgaaaagcagaaggaagagacgggggtgaacggacggtgtgtanggggtgaggtgtcacttcagagaggttccctgggntttccggcgacgccctccttcaagcgaggccgcaggcttcggaggcgtgcgctgctgctgggtgtgcagcccccgaggggtctcggcagcgcccgggtnctggctttgcgtattacagttcatctttcacagctttctgatcatcgtcttcctccatgtctggctcctctgcttcttccaggtcctcgagatcctgggatacaggaaaaggggcggggcgggcaggttggctgcaacagctgaggctgccggcccccnagcaccccacactgctcacaccggggactagccggccacggcggacatggccaccggccactggagcagccaaccctggtctttacgagctacacaggggtcttcccnaggaagagtgacgcctgggggatttctgcctatagcaggatgaatcagagcccccactgtgtcaggaaccctgggaatcccagctcagccttggacccttccactgggcatggaaggcgtatgtgtgtctcccagcttggcaccatggagtctacagagggtccacatctcggcagggacaacagccccagcatgaagtccaggcacagtcaccactggggtgtgaccattctacttccaacccttgggctctggccaatgacaggccacaggcagcaccaggggccggccctccatccccagcctgggcagagtattcccacctcccactgtgcaccagcactcccagcaggccctgccagcctgggctgaccatgccctcatctccttcaccatggtcaagcaccccgcccctgccgcatcctcccaacaccagcncttcctgcttccccggcagagtcaccactgcntgctggccacgcgctgacgggcaggactaaactcccgagggcagacccatgtctgcgcccttgtgcccgggccccgccagcgggctggggatggacctctgagtccaagttagcagcatgtgaggaaccggtgccatgtgtctgaaaagngttttctaagcaaaatctggtttttaaagatgccttcaacgtcgtcccctaaagaagtgctggccagggagagctgtttcagcagagcactgggagcacatcccttgccctgctgggcgnaaggtgtnggggccccagagccctggacgcacagacgtgcctccaatggcaccattcccatcacaagccgagcccaagtgggcatgtcccgtggggccaaggggctgaatcccagagaccagcccagggctgtgaccccactcacgtcatcatcccctgccccatcctggccaccgctctccanggaatttcttaaaaccatccagcgtgcgttccccgttgtaatcaatgacctgtggaagacagggatgagtgcagggngctggtcccggcccagagccaatctcctggcattggctcctcctccctagagaaaggcagagcaggcccggtccgngtggctcacacccggaatccagcacatntngggagttcaaaaacagcctaggcaatatagtgagatcccatctctctcgaaaaacaaaggtgggtgcttctgaaggagctcccacagctcttctccncacctgactagccccaggctccttccagagaggcacccaggctggcgtggggaccactgctcttcccagagcccgccccagccccgtctggagggaaggcgcaccgtcctgtcggcactggcaggaaagaacttgagtgtggggaagctgtgcactttgacggcctccancctcgttggcagtcgagtccatcttggcgatgacgatgttctcatggtccttgtacgtctctcccagtttatcccaaatngggagccaactgtttgcagtgacncacaccatggggcatctgaaaagaaagcagttctagggtgtgtcctggacacaaagccactggcagacgcttccccaggagtctgcctaccttgcgcgtgccctggtggcacggacctggggagctgaaagggcaacacttacagaactccacaaagacgttttttttctcatcaaaagccacgtcttcaaagttcttcccaacaagcaccttgacaggctgcttgtcccagtcctccggcagctcctggctcatcaggtggggctggagggcaggcagggcacggtgaggggcggcgatgcctgggggaccacagagctccccaanccctcaccctgcccgggactgaggtgcgtggctgccctgggcacaccagggtggcagccgcagacaccaacagtgccaagaatccagaaagagaaggctgggccagtgggctgggcccaatgagcccacgcaggccgcaccctcgccggccaggaggtttccctgaggagcatctgggccagccgtgtggacaagagggctcctacaggtccccaaaggtgtgacaagaatggtggtcttcacaccatcttgggctccgtcctcttactctgaangatcttactttgaggacgaagcccaggacactgagagcccagagaccccaaggtggcggctctacccgggaggcagccnctggcccggggacgcgcctgcaccttgattttgccctccaggaangcggtggcagaactctgtgatcctctctgccgtcagctcctccgattcgggcttgtacttnggtcatctcctccntcncagggntgatgaggcgcacggccgggcactcttccttcttcanggccaaagaactcgaggatgcgctggttgtcggtgtggtcgctgtcgatgaagatgaacaggatctgggggagaaaaggaggttgcacaggntgcgggagacggctggcctctgcctccagccctgactttgctcggaagcagaccgtgctccggtgcctttttcctccaacctggattccggggttgcccaaccagaccagcaggtgactgggagcagaggtctggcctggnctggcccctcgcctacatccaggctgtcctgaatcaggtgcccgatccagtccagcaggcagcctcaggaaggccccacacttgtcacctcgggaagagttgtactgctccctggcaccgccccacgagccacccagaagagcagctcaccttgcccttgaagctctcggctgctgttttgaagttgctcagtttgccgtcatagtcagacacactcttgggcaagaacagcaggatgtgagtcttgatttcacctccaaaaatcttcggggctgtctgtgttataaacttaagttactgggtctgagtcacacactattaatgcagaagattctcccaatggcctccaatgtcagacgctggacagcagtggtgaccgggagcctcatgccaccccnnaacccactcctnccccatccccagcctgggggctgcagggcagccgcacctgctcggtgaactcgatgacaaggggcagctggttgtgtttgataaagtccagcaggttctccttggtgacctccccttcaaagttgttccggccttcatcaaactgtggacagaaagagggccctgactgagcattgctgctgggagcacagcccctgggcccgggtctccctggacgtgggaagtcacagcagccagcagccctgccctcccgtggggtttcgagccacaggtccagcaatgggtacaggacatggctgttcctcgacagtaagactggctctggtcacggccttatggctgcccgtgaattcaacagctggcttcacatccacaatgcaagcctggcgcacgtggtcctccagcaaccttgaagtgtggcccatccccagggcccctagccttttcagggcacccatgtggtcaaagctattttcttttttatttgtttttgagacagtnctncgnctctgttgcccaggctggagtgcagtggcatgatcttggctcactgcaacctctgcctcccaggttcaagtgattttcctgccttagcctcccgagtagctaggactacaggcgcctgccaccatgcctggctaatttttttttgtatttttagtcgagatggggtattaccatgttggccacgaaggtcttgatctttttttttttttttttgtgatggagtcttgctgtgtctcccaggctggagtgcagtggcgtgatctccactcactgcaagctccgcctcccggattcaagccattctcctgcctcagcctcccaagtagctgggactataggcgcccgccaccaccggctaatttttggtatttttagtagagatgggtttcaccacgttagccaggatggtctcaatctccttacctcgtgatctgcccgcctcggcctcccaaagtgctgggattataggcgtgagccaccgcgcccggctggtcaaagctattttcacactcacacttctctggcctctgccttttcactctccctctcacgtgctgcggcacagacccacagaggctgctgggcgcatggtgtcgcaagagcaggagggcaggagaggagaatcctgctggaggaatctaaaacatcactcagcactaaattgtttttgtctgggacaaactagtttccgtaaagatgtgatttatgataacatgtaatgggattattattcttttaaaataaatttggctacagtggctcaggcctgtaagcccagcactttgggaggccaagatgggtggatcgcttgagaccaggagttcgagaccagcctggccaacacggtaaaaccccatctctactaaaaatacaaananataagnctgggcgtggtggcgggcacctgtaatcccaggtacttgggaggctgaggcaggagaatcgcttggacccgggaggcggaggttgcggtgagccgagatcgcaccantgcactccagcctgggcgacaagagcgaaactctgtctcaaaaaaaaaaaaaaaaaaaaaaaaaaggccaggtgcagtggctcacacctgtaatcctagcagtttgggaggctgaggcaggtggatcacttgagttcacgagtttgggaccagcctggccaacatggtgaaacctcgactctaccaaaaatacaaaaatttagctgggtgtggtggtgcacacctgtaatcccagctgctcgggagactgaggcagaagaaacacttgaacccgggaggcagaggttgcagtgagccaagatcgtgccactgcactccagcctgggcaacagagcaagactnctgtctcaaaaaaaaaaaaaaatacaaaaatacaaaaatcagttngggtatggtggcacctgcctgtaatcccagctacttgggaggctgaggcaggaggattgcttgagtctgggaggtagacattgcagtgagatcgcaccactgcactccagcctgggtgacgagtgaaacaggccaggcgtggtggctcacgcctgtaatcctagtactttgggaggctgaggcgggcggatcacctgaagccaggagtttcagagcagcctaatccaacatggtaaaacgtcgtctttactagaaatacaaaaattagctgggcgtggtggcgggtgcctgtaatcccaactacttgggaggctgaggcaggagaatcgcttgaacccaggaggcggaggttgcagtgagcccagatcgtgccactgcattcgagcctggcaacagagcaagacttcatctcaaaaaataaaaaataaaaataaatagagagaaaaaaacgattttttacattcttagttctagtttctaatacaacagatcctgaaaggcgcaatccacgtgcctgtaanggccctggggacccctaataatgcacggcagcttcagggagtcctaaggccacaagatggagaggctgtggcgccccaaccacgaggggtcagcctgcagctgaggatgcggcctcggctcaggctcagagaggcgcccctgtgctgaggctcttcaagtgagaattttgggtgagccttccatcattcccccgaactacttttttatttatttttaaaatttatttatttttttattttttgagacnggagttttgctattgtcacccaggctggagtgcaatggcatgatctcggctcactgcaacctccacctcccgagttccagcaattctctttcctcagcctcccgagtagctgggatcacaggcacccgccaccacgcctggctaatttttgtatttttagtagagacagggttttaccatgttggccaggctggtcttgaactcctgaccccaggtgatccacttgcctcggcctcctaaagtgctgggattataagtgtgagccactgagcccggcccaaactattttattttttttttgagacggagtttcactcttgttgcccaggctagagtgcagtggcaggatcttggctcactgcaacctctgcctcccgggttaaagcaattctcctgcctctgcctcccaagtagctgggattacaggtacgcgccaccacgcctggctaattttgtttttttagtagagatggagtttctttctnccatgntggtcaggctggtcttgaactcccgacctcaggtgatcggcctgcttcggcctcccaaagtgctggaattacaggtgtgagccactgcacctggacagaactactttttnaaatacttatttatttaatttattttattttattttatctattttgagactgagttttgctcttgtttccctggctagagtgcaatggcacgatctcgatcttgcctcattgcaatctccgcctcttgggttcaagtaattctcctgcctcagcctcgcaagtagctgggattataggcatgtgccaacacgcctggcaaattttgtatttttattagagatggggtttctccatgttggtcaggctggtctcaagctcctgacttcaggtgatctgcccgccttggcctcccaaagtgctgagattacaggcgtgagccagcgtgtccagccaaaaaaatttattttatttttactttttgtagagacagtcttactatgttgcccaggctggtctcagactcctggcctcaagcaatcctcttgtcctggcctccctaagtgctgggatcacaggtgtgagccaccaagcctggtccccttgaaccttttttttttttgagacagagtcttgctctgtcgcctacgctggagtgcagtggtgcttctcggctcactgcaagctccgcctccntgagttcacgccattctcctgcctcagcctcctgagtagctgggactacaggtgcccgccaccacgcccnggctaattttttgtatttttagtagagacggggtttcaccgtgttagccaggatggtctcgatctcctgacctcgtgacccgcccacctcagcctcccaaagtgctgggattacaggcatgagcccctgcacccggcctcctcaaacttcttaaatgagacttggggaaataaatcacgcatcctttcttactggnccgtttccatgtatgcgtctgcagagtaacttagagaccaggtgccactccctgctcttgtgcacgctgtgcctgggccaccctggcctggcctgactgccaaggagctgatgttaaaccagggcacaagcaccaaccaccctgcccgaacccgaggggcagaggcttctaagcctgctacctcttccccagaggggcaaaggcgggtaaggagaggcagaaaagccaagttcaggaggcccttggagggaatcctttggaacatgagctgctgatcacagccgtgctcccagtggcacgggtgggctcgcactgtgcccaggagtaacgccgggccgcaactgcaggcaaacgaaatccccccacccctgcagaacaatgtctctgactccctccagagtgtcaggcgccgcctacaccatctcatgccaagaagccaggnaggagacactgccgcagctgtcccagggctgccatcgtttcagcagagatgctacaccacactcaatcacggtctactgcggtaagggaaactggtccacttagcagggcacagcagcaggaggccagccctgccaggccacgngtgacaaacagcatagaaacgcccaatgcaggccgnggtggtatggctcacgcctgtaaccccaatgttttggcaggctgaggcaggaggattgcttgagctcagaagttcgagaccagcnctgggcaacnacggtgaaaccccatttccacagaagtattaaaaaatagccaggtgcggtggtgcacacctgtggtcccagctactcagcaggctggggtgggaggactgcttgagcccaggaggtcgaagctgcagtgaagtgtgattgtgccaccgcactccagcctggtaacagagcgagaccctttctcaaacaacaataacaggcccagtgctgccagctgggggagaagaaaaagtgaaatatcagaagctctcacacccatggtgccagtgaccagcagcccccgcagaggttttcctgggttgcagtgcctgctagggaaggaagggaagagcaggcaagagcgggccacacaagagcacccgactcagccaggctgcccactgtggccactgcacacacaggaaggcctcactcactttgagggatgggggttaacagcctggtggnaaaaggaacaagttggactcatcctctcagctgcggggtgagctctgacttccagggcagcccctaccacgtgcaccggacagggggccgggcttctgcccggagctgccntgcaacgaccacgttcgccatcacagacacctgagccaccttcagtgggcaggaaagcgccacccaccaactggcatcaaacccaagtgggtttgtctgtgcccagctctagtggactccagagaatggagacagaacgttaacctgtggggagcccacatggatggccacgtgtgagcctttgcaggcaagagcaacgaaaccnaccctcccagccttcgcggacacatatcaccaaanctgtccatagagtcacagcggccactgcagacatccagggcactgaaggagctgtgggctgtgtgacaacacagnggttcgcgagtttcgtgggctctggagaaagtctgccccagaacccaagtttcanggacaagacttggaactttctctttaataaaagctctaaaaagacctttggttccttcaactttatccaacacttcactggctttttctagtcagaggtttaatttcctgggcaccttgcaatggcaatagactaatttagcaactctcttcccttcaggggacatcaagagaatgtctcctggtaaagagcatctactgtcttgagttatctntgaggaagtggctgcnaaaacagctaaatgacaagaacaagaacatggaagcaagccatcctgacccacccgcaccaccgcgctccaggaagctggctctaccctccctcctacctggtcccggggagtgctggatgctccgtgcttactacagaaagtgaatgggtcggtggctcacacctgtaatcccagcactttgggaggccaaggcaggcggatcatgaagtcaggagttcgagaccaccctggctaacacggtgaaaccccgtctctactaaaaatacaaaaaaattagctgggtgtggtggcgggtgccctgtagtcccagctactcgggaggctgaggcaggagaatggcgtgaacccgtgaggcggagcttgcagtgagctgagatcgcgccactgcactccagcctgggcgacagagacagactctgtctcaaaaaaagaaaaagaaaaaaaaaaagaaagtgaatgggttccttgtgtccaaaaccactcagccccaatcccagaggctgcccgtctgaccgtttggcttatgatgctgctgtctaaaaggttcttctcccctctggaaacgacacangacaggagctganaggtccgatcgcccccggccgccctncctgcccctcactccccaggtccctcctctcccgagactttctctcctatccacactaccctggctctgagcggcacaaacccaccatcacccacatccaggttcagctgtccctagagcacaagtgtgcggccccagccccacctgcctggtgaccgagaaaagagacaatagaaacccacaggccccatcttgacactgtgcaaacaaggaccctgctgtgtcctggtaacgggnagnngcgnnnaanangccacactgtccaggagcccttccccagnagnaaggacagcgggatcangatggcagttttnncacagtggatccttangggntcataatgcccttggggctgaggggcatacgaagtgtgggtgccacctgggtgggaacacgcccagagcgccaatactccagacctctgggtaaggaaaacgttctggaaatagggatgctgcaggacgctctgaatgtagttaatactttagaatagttaaaacgtggccngggcgcggtggctcacgcctgtgatcccaccattttgggaggctgaggcaggcagaccactcggagctcaggagttcaagaccagcctggacaacacagcaaaaccccatgtctaccaaaaaatacaaaaactcagcccagcgtggtggcacgcgcctgtagttccagctgctcgggaggctgaggttagaggatcacttgagcctgggaagcagaagttgcagtgagctaagaatgcaccaccgcactccagcctgggcggcagagtgagaaaccctatctcaaaaaaaaaaaaggcaaacggggccaggcgcggtggctcacatctgtaatcccagcactttgggaggctgaggtgggtggatcacgaggtcaagagattgataccatcctggccaaaatggtgaaatctcatctctactaaaacaaagattagctgggcatggtagtgcatgcctgtagtcccagctactcgggaggccgaggcaggagaatcacttgaacccaggaggcggagggtgcagtgagccgagatcacgcaactgcactccagcatgggtgacagagcaagactctcccaaaaaaaaaaaaagggcaaatgttgttacatgnttttatcataattgaaaaaaaaaaaaaagctaacagtcaaaagcagttctgaggcggctgtggcaggagagtggccagaaagcccacagctgaatgcgaagaccaggccacaggcatcagcgcaacaccccaacttggcaaagctgcagaacatacctattgggccaaaggtgccaggagcaaggttcccttaacgataaggagagcaacgccaccctctgcagaccaaccccagaactaacctgggcagagctgcctggggccactcaccttcttaaagaggacaaccccatctttgtcgagctggtatttggagaacacgtcactgttggaagtgatcccaaatggtatgtcatcgatggcctctgctgcctgcaaaaactgcttggcagagtccgactccacgtcctgaatgaggnagggagaagcagaggtcgtcatgatcccgcagcaccaagcagtagggcagaccctgtagagcccaggccaggggggacacgtgcagaactgccagctgcaggctgtggacccctcctcaatggatgacggaaggaaggaagactggaatgctctggtctctaccttgaagaagccgatgacagccacctcgnctggactccaccaaggactctgcagctgcgccgtcaggcagggtggtggcagccgggcccgtgcgcttcttcagccagttcacgatgtcatcagcctctctgccagctaaccccaaacaaatgtaggttctactctcaaacagggagtgccgcctgccctgccgcgcctgctcccgtctctgctctctgccagccaggctgaggacacctgaatcaacctaagtaagatgttctcccaccatggaagaggcccggtgccgtccgcccgcctcctaaaccccagtgtacgtgagacntgtggttgtgtttatggggagtggagangggaangagnggtgattctgtctctgaataacaggatcacaaacccattttttttctctgatctctctgcattttcttttttcttttgacacaggggctcactctgttacccagctggagggtagtggcagaatcttggctcactgcagcctccacccactgggctcaagcaatcttcccaacctcagcctcctgagtatctggggtacagatgcacgctaccacacccagctcatttttgtatttattgtagagacggggttttgccacgttgcccaggctggtctttaactcctgtgctcaagcagtttgcccaccacgacttcccaaagtgctgggattacaggcatgagccaccaatcccagcccttttttttttcttggaagacagggtcttgctctgtcacccaggttagagtgcagtggcatgatcatggctcactgcaacctcgaacttctgggctcaagcaatcctcctacctcaggctcccaagtagctgggaccacaggcatgtgccaccacacccaactaacttttttttttttttttttttgaggcggagttttgctcttgttgctcaggctggagtgcaatagtgtgatctcggctcactgcaacnctccacctcccgggttcaagcaattctcctgcctgaccctcccgcgtagctaggattataggtgcccgccaccacacccggctaatttttgtatgtttagcagagacagggttccccatgttggccaggctggtctcactcctgacctcaggtgatacacctgcctcagcggtctcccaaagtgctaggattacagaggtgagccactgcgcccagcaatgtttcttcttttttttttttttttttgagacggaatctacctctgtcgtccaggctggagaatgcagtggcgccatcctggctcactgcaacctccatctcccaggttcaagtgattctcctgcctcggcctcccaaatagctggtattacanggcgcccgccaccatgcccagctaatttttgtatttttagtagagacggggtttcactgtgttggccaggctggtcttgaactcctgacctcgtgatccgcccgcctcggcctcccaaagtgctgggattacatgcgtgagccaccatgcccggcncnaatttttctattttttgtagagatggggttttgccacgttgcctaggatggtctcaaactcctgggattaagcagtccgcccacctcggccttccaaagtgctgggattaccgggnatgaaccactgtgcccagccctagctaatttttgtattttttgtagacagggtttcaccatgttgcccaggatggccctctgcattttaaaaattttattttttgaaacgaagtctcactctgtcacccaggctggagtgcggtggcacgatctcagctcactgcaaccttacctcccaggttcaagggattctcctgtgtcagcctcccaagtagctgggattacagacgtgcaccaccacgcccggctaatttttgtatttttagtagagacgggggtttncaccatattggccatgctggcctcgaactcctgacctcaggtgatccacccgtctcagcctcccaaagtgctgggattacaggcatgagccaccgcacccagcctgtcctctgcgttatctaaattttctttgacatgtacatccatcaaacacatgttctcacccaggagtctgacagcaggcctcattttagagaggtggacagtaactcaaaactcagtgccagttttctacctctgggaacaggctgacgccccgcccacctgactcccgcgcctcctaacttatcccaggcgtttcgggagttctcgccaatggcccaccctccatgcctcccagaccaggaagaagatgacacancttttatgccaccaaaggcggtcaactgacaggaaagaaacttcctcctcctgggagactgaggctaaggaatgatgcctctcctttttccctcctagaacttgactccctggtccgaatcgggaaaaccccattcagatgtagaaggattccaccagtgctaacaagacggtcaccagtgacaagtggatttaggagtgctcatctcatctgcaaacctgagtgttagtgacagaaccacggtgactttggacagagcacttcccgttccaaaagtgaacatgagtaaaaaatgagaacatcaatcacgcctgtaatcctagcactctaggaggccgagacgggtggatcacgaggtcacgatcgagaccatcctggccaacatggtgaaaccccgtctctactaaaaatacaaaaattagccaggcgtggtggtgcacacctgtagccccagctactcaagaggctgaggcaggagaatcacttgtacccgggaggcagaggttgcagtgagcagagatcgcaccactgcacgacagagcgagactgtctcaaaaaaaaaaaaaaaaaaaaaaaaaggaaacatcaaaacagccaagtgagaggcaaccacagagctgctgccactagaacaggacagggcacacctgcttaaggggacaaaaggaaacatcaaaacagccaagtgagaggcaaccacggagttgctgccactagaacaggacagggcacacctgcttaaggggagaanccctgctaacactggaatgagctgctttcgggctacccancatgagcatctgacatgccacagaaccggntttatagacgagttttcntttgccaccgtcactgatctggctacacaggggctcggcctccactacggcagcttcagaggcggcagacgagcagctgagggcccgtgctacagacggagcagggcgggcttggattcgaggtctgctaccgacaggctcgatgctgttactcagctgctctaagcctcagccctttgtctgggaaaagcccgcctcacagagaggatgcgaggagaaatcacgcaagcacgtgacgcggcagctggcacgctacacacgacagctagcaggtgtcaccccgagagctacagccatgctgctgctcctaggnaacagggggcagcacaaacagcccatgtggccagaaaggcaccagtcntccctctcctcgctggtcagtctccaaacagacctcagccagccgcccccaggatggcaccagacaagacaggttctccattcgaaggttcttccaggatgaaaactcctcacaagaccctcagggcacaagtggacagagaacccggcctgaggaacgggatccctccaagcctctggaacccggcctccccaccgctcagacagctgcccctgcccttccaagtcggcaggccagtccctctctaaagacagttcaagggcagtgccacagccacacctgtatattccttgggggaagccgtgtctccattcctgaagaacttgatggtgggatagccgcgcacgccgtactgctgggccaggtcagactcctccgtggcgtccaccttggccaacctgatctcggaaccttctgccttcagcttcccagcggctttggcatactcaggggccagagccttgcagtggccacaccaaggggcatctggaagcggaaatgagatgctagaaagcagccttgatccctaaagcagccttgatccctcagcagtgcttccctttttcctctggcatttcccttcataaaaaccttatctactcaccaagataacccctcctaacgcacaaggctgagctgatagcctggtgttcttgggcaatatcaggacagaggccgntgaacgacaaactaccaccnaaccaacaccagcccccactctgctatgtcaccatcagcacagccagacaaacctttcaatggttgctgacttcttattccccacaggcaactaaggcaaggatctcccctagacntttccctttaagactacagacaaaagtgaagaagtgaccgtggcggcctgtaccagcactagctgtgagtatgagatgcacatccgtgcacacagaccctgagttgcttagggtgagaataagacgatctgtcaatagagttagcagcntgtgtcaggcacaaggttcccaccccagggacagagctcaaatccttatggacgtgaggaaggcttgggattctcctctgagacaccatcggaaggactgctgtggcaagctgaaggtggggtgggcaggagcggggcgccttccgggtcggcccccggggangganctcggcaaggctggacactggcttgctctgtttgctcacacaggtcgatccntgttcttctcgcactaacaggaagatcctgccgtgcgcagggcgggcatcgggacggccccccggnctcccagcccggctctcacccccagggagcccctgacatggcccccaaggcgggcagcaagggagcccttcagttccgggcgcgccgggggtcccgaccccgggggctgccgggccgtgcctgcgtcccaagagcctggctcagcggccccgagccccgcccgcccgccaggcccggcgctcacagaactccaccagcaggtacttgtgggccgccagcgcctccgcgaagttgcttttccgcagcaccaggacgtggtcctcctcctcgggggcgtcggcgcgcaccagggcggccacggccaggcacagcagagcgcggcgcagcatgtcggacacggatcaggcggggcgcttcggttggcgccgccgggacagcgggggcgacgagagcgcgcgccggtcccggcctcgcctttataaatcctgggtccggggcgcgcctgcccccccngcccgcgcgcgctggccgcggcgcgcacgcgccgctggggcccgccttcgattggccggcggacttcgaggctcgtctttgccgctctcggattggacactcacaccaggcctggccccggattcggaaacgctcctgagtgctccctggccttcgttcgggattggccgaggacctcgcgctcgctgtctttcttagcctctcattggctcccgacaagaactttttctgccttggcttctaattggtggctttcgcctgcaccttccacgggtctggaatggctgcccctttcggtagcacggactctgcgcctcctgattggccaagggatgcgcgcactctgcgcgttccttcgtcgaacgtggcagtggggaggagttcccagtttaggggcggagctgcggctgcgcttccgaaacccctcgtgttgcattctgactggaccgcgtacccaactggcacgccccccggcccccggaccggaagttggggtgacgcaatttccggcgcgcgtgtcaagcgtgcggcggcggccgtggaaggtggggttggccgcctagggtcggcggtgggctcggtgtgggatagccggcccggtccgacgcgctccgcgaggtcacgcgagacactcaccgaggcatggcggcagggcctgggcatgggaatcgtgcgcacagtgcgaggaagcctcggaggggatacgagcacagggcgggtggttaggagaatggggctggagagacgggcgggaggggcgggacctgggccccggggacctgccggctcccaggccccaggaagacgctgctcatgcgtggagcggccgcaggaaaggtactccccgctaaggccttcagggagcggccctttgccctgtgcgatctcttccttcctttcccacgggttgccaaatcctgtgacgctgccccttctctggtgcttctcagatgctctggtcggctcaggagacctcgcagctgttacacagctgtggaaataccctgggcgctgcttcactccgaaggcagcagctgggtttgcctcccgactcgacccgccaccgaggctcntgagcacttgaaatatggccagtccacctgagacgggctgtgagtgcgcaatgcacatcaaacttctaagactgagtgtgcggggccgagtgcggtggctcacgcctgtaatcccagcactttggaaggccgaggcgggcggatcacgaggtcaggagttcgagaccagcctgatcaacatggtgaaaccccctcacctcccgtctctactaaaaatacaaaaattaacagggcctggtggcgcgcgcctgtaatcccagctactcgggaggctgaggcaagagaatcgcttgaacccaggaggcagaggttgcagtgagccgagatcgcgccattgcactccagcctgggcaacagagcgagactccatnctcaaaaaaaaaaaaaaaaaagtgtgcgtgtaggggctggaggacagaaggtacagtatttcgttaataactttacattgactactacatgttgaaatattctgtatgcatatgttggattacataataatattgaggccagngtgctgtgtggctcactcctgtaatcccaccacttttggagaccgangcangaggatcccttcagcccaggagttcgagaccagcctgggcaacatagtgagactcccgtctctacaaaaaataaattaaaaaaattagccaggcacggtggtgtgcacctgtggtcccagctacttgggaggtggaggtgggagaatcatttgagcccangaggcngangctgcngtgagccatgatcccaccactgcactccagcntgggcgacagatcgacaccctatctcaaaaaatagtaaaaaantgtccttttttnaaaatttttattttttatttttttgagacagaatctcactttgtcatncaagctggagtgcagtgggcgatctcggctcactccacctcccggattcaagcgattctcctgcctcagcctcccgagtagctgggattacaggcatgcaccaccatgcccagctaatttttgtatttttagtagagacagggttttanccatgttggccaggctggtctcgaactcctgacgtcaggtgatccacccgccttggcctcccaaagcgttgggattataggcgtgagccaccngcaccnnaggncctcctcttctatcttttaacgtggcttttagaaacttttaaaattacatagatggtctgcattttgttagtgttggacactggcagccctccgtctccctcactgcctggaatctgctgctctccttttccccaggtgcctgccctctccattcctcctcactttcctccgctgggaatcggcaccgccactgattttaaagttgaaacttggcaggcaaaagggaggtactcccatgttaaatgtatacacattgactgcnaatagtatcctgacttttgaaatggtaaaacgtagagtaagttgcttttgtactttgagagtttctgttntgttgatcagttgttcctgagaacatgcttctccttccgacagggaactccctccactagaatatgagctccttgtnggtcaagactgggtcccctgttcccttccccccagtgccagcggangcaaaggtcagtcagcggcataagttgtacctgctgggagaactgtctgcttcctccgggtgacttttctggccaagaaggaatatgagtatgtgcctccctgagcactggcctggagcccactcaggaaacaccatctcttcataaatggttttgattgcaggncattgttccttctgctctctggatgatggaaattgcttcaggtcactgcactatcttccaacgtttttgtggttgccatgagctgttgtacagaccacagtttggggcctgagacaagctgggcatggtgttgcatgcctataatctcagctactttggagggtgaggcaggagaatagcttgggcccaggaggtctaggctgcagtgagccatgatcataccactgcacttctgtctgcgtgacagagaccctgtatcttacataaaaccccagcccatatttgtaccacatctagatacgaggtcagagttcagatgcctaaatattgtagcttgtgttttgtccacntgttgggggaagagtgaagagatttgacataccataatgttgattagcttgtgatggtttggcggcagcttaggccagagcataaagtaaaaaggaaaagtgttcacagacaatgaanaactgggaccaagtggtgaatactcaaggcacacagaccaggcaaggatcccagtggccgtggatgagtctcaggctggctctgggccagtggaacacacctcagtgtgggtgaaggcctagccagggtagcagagggcagggctacagaacagcagcccaggtggctgtggccgacctgacattctcctgtgaaaatcaggtgcccaaccagcactaatctagatagatggcagcattttttttctttaaagacaggatcttgctatgttgctcaggctggtcttgaactcctgacctcaaaggatcctcccctcttcagcttcccaaagcactggggttacagatgtgagccagcacgcccagccgaatcancagtatcttagacagatgccatggctgcccatagggtcctctcaaggtgcctctgcccttggactggcttcctacaccaacctgacaggtgcagcaaaggtggactttctggtaaggctggaggaggaagcctggtctgcgatggcctgagacgccctctatgggggttgttgagtggatggaaatgtgcagggcatgggtcctgcccccnagaatgcaggctggttccgctgggncacctgcagagggctgatgtccttttcctgaggcctgctcctgtgccttctaaccctagggtgagaagatgggctgtgttcacctcatgcccaggcccttcgaggagtgtgcccttgggggtcagagccctcctgtggctggtatttctttggatcatcancaggtgctccnagacatcctttagggagtctcaggcttggtgaagggatccattaaatgttgcttagttggtttttgtttgttttttgttttttcgagacagagtctccctctgttgcccaggctggagtgtggtggcgtgatcttggctcactgcaacctccacctcccaggttcaagcgattctcctgcaacctctgcctcccaggttcaagcgattctcctgccttggcctcctgagtagctgggattataagcgtgtaccaccaacccntggatgatttttgtantttttagtagaggcagggtttcanccatgtntgtcaggctggtctcnaactcctgacctcgtgatcctcctgcctcggcctcccaaagtgctgggattacaggcgtgagccatcatgcccagccaactggtttgtgattaaatgttttgattgatgcagtttttgaaatgtactgntgtgtacaatattactcttttgagacagggtctcactctgtcacctaggctggagcacagtggtgcagtcatggcccactgcagcctctgccttgtagccntcaagtgatcctcctgcttcagcctcctgagtagctgggactacagttgtgcaccaccatgcccacctaatttttatttttttaaagatggggtctcctgtgttgcccaggctggttttgaactgctgagctcaagtgatctgcttctggccagctactactcttaaaagtagagttctcagagcaaaacagctccctttcaacncttcagtccggtcgaaggtgtggtgggggtaacaacagcaggctcatggatacctgggcagtgctccgaggtccctcctgtgttcccactgagcagcagcctgctgtgcccggagtggaggtgagaaatccagcagcagcgcggtggtgagtgtgggccctgcggagtgtggcaggcgctcattatggtgcagggcagtgttgggcacagagaaggttctcagaaaccacagtaacccatggttagttnggtcacatcccagaccctgacctagcactggctnggcnactgtgacttgtcactctcctgaatggaagaagtgtccacctgggggtggctgaggaggtggatgctaggggactgctgggagccacggacctgtggaggttgggagaggagactgcaggcgcaggctgctggaggcgaggaggcctctctggagcgccaggccatacaaacaggtcccaggtggggccacgaggatcaggttagacttgggacccgagagacacgtcatgcccactgtgcaggtgccacctcatgttatcctgcaccagggngaggggccagcccaaagtcctggctgctggcagcatgcccgtacagcttggcacctgggtctgagttcacatgtctagcaaagctgggaaaatccaggagcaagaaggtgaagccctttggctcagcccaagctcagaaggcccttgcccgatgagccgaactgctgacaacaccctggcactgggcttggggactcccctggagcatgtaagaagtgaactgggagcgtgggagaaactgtctggcaggggctgctgcctcnggagctcatcctccctggctgtgctggtgtctgtccagtgggattagcctccatcnctgtggtttcaccaccccaccgcctctctcccccacagcacaggcagaagcagcaacgcaacacgagaccacctcgcttggggctagtagcagttctgggaaaggctcggtagggtctttgctccctgcggaatcaagggctgggggctgacccaggctttctctatagctgcttccagatctgggtctggaccagcttctgcaggaaggcaccattctgttggggtgtctgacacggtcagctctaggctcagcctctgcggcccccacaaaggcctagcaaggatggggcaaggtggcagtggtgcccgcacgcactgccctggcacaggtgtgtagttagtgacctgaagcatgagggcatctccctgcccaccccagctggagataagccccttgcggggcccaccctgctgatnaaccccagagcagtatggcctgtgtcagaatgaccagtaggagggccccggggtagcagctgcccagcccagctgcgtgtgtgtgtgaagtattttcctcnaacaccttataccacagaaggcagattttgaaactcgcatcaggccagaaaaagaatttctgaatggacacttctaaggggtgcctggttactcatctgcctcttccccctgcagggtagaggggcatgggtttgaagttcccgggggctcttggagactgcagacacggacgagctggggttcctggatgctgcagcagttggggcccctggctgagcgcacctgccccaggaggccctgcgtggttcccnccagtagccccttcacaccacaccgcagtgaggatgccctgtctcctgccgatcccatcacaccaagcctnttcgctgttgggctcctggcactgcccgatcctggagggcacttggctgcggctgtggctgtgaagggctggtgctctaggcgcctccgtggcccccgttgcctgggcacctacttccntgcntcagccacagctgcatccacgtgcgccaggggccacaaggccgaccctggcttgggcctgttcctccctgggtttccttgggatccagtcattggagggcccgcgcacagctgggccaactcgacacctccaagcccggccagggaatcaagcagctctccctctggcagcatgagctacacaagccaggcccgtcttcccattcccttagcaaggaggggcaaccccagccaaggccttctgcactgttctagactgttgctgcctagggctactgtagctgggagtcacattcctttctccccagatagttgcaaggggcccagcagccacagcanttcaagggggccctgcccttcccctcccaccaccccaccagggtccccatcttcccctttgtctcctaaagcccgtgaggcagtagaggagccaggccctcccctgccacaccctggnagaagccaagcagcagacacccccagctccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctgngctgggtcagggaaggcctgccgggggtggtggcactgagagcctgggggaacaggcgccaggccagtggcccagggacggcacggacggaggcaataaatactgatggccaggcggggctcctggctgggcccaggtggggtgagtgaggctgtccatcgagggctcttgggggggtgtgggctctgggcactgcccgctgagacagaaaaggcagaggcaggacaatacccagcctcctggatggtactgaggtgacttgagttttggcaatttggctttccccaagccgccgngagccatctccacagccctgtccagggaagggggcaggctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcggggctggaggacggcccggcccccacgaggccgtgcatcccacaccccagctccaccccggagcagcagacgcacacgtccaggggcaaccacggggcctggagaatggctgctccgctccctcctgaagccagncntcgggtgtgacggggagatagaacntggggggcacagaaagggcagcagaggcctggctgcggcctctctcccccacagcacaggcagaagcagcaacgagacaggagaccgaggaggctgggcctgtgggtgggggagggctgaggaggggggtcggaggcanctcggttgagccaggccagggaggcggaccagggtgggaggggcacggagggcctgtcagcactttggtatggggaggggaggggctgggggggnacacatnccngccnngtccgtcgtccgtccgtcagtctgccctgcccgcctctggctgggctcagtccttccagtccttcttgatggtgagattccactcccaggacaggtggtcggtctngtcgtcgtctgtgaagcgggacttgatgctgtagctgccccgggccagcatacccttgggtgcctcctccacgggggtcaggaactcgtactcctcggcccggggcccatagctgcctaccatgtagtcagtcttgtcaactgcggcacaanggaagagggcggtcagcggccccgcttccccgccntggcagcacgcacccaagcggccccctctgccctgcccggggccccactcactcttgacgcctttcctgtacgtatgctggatgtacttcatgccggacactatctctcggttaacctgcaggacccgaagcgaggatcagggaaggtcggtccggaccccagccccagccccgcctccattccctggccacagcagcctgtagcttacccggaaagagatttttatccggtactccacaccctccttcagcacaaacgactgcttcttgaagctctccaggtcgcctgttggggggacctccccctcaatgactgcccagcagccctgcgcgaagccccagccctgcgcggccccctggctgcacttcccgagatccccaccaggggccgncccggacccccgcggccgcagggncactcacccgtcaggtccagctccagggggcccggggccgagctgcacaccagggtcaggccagtcaccnacgacgttggggacgttggggtctggggagtgacagcaggtgagggccccacccccnaccagtggaagtaggggctggggagcggcaagacagctggagtgaacgggcggccacccggctcccgcagcccagactcacctgcggaaancggccacgcggcccagcagggcctccttgtactttcgcaggctctcgtcgtccttgtccagctcctggatctcctggatgctcttctgggccgggggcttgtagttngaccgagtgctcatcctccnntcgttctccgctgcaatctgggccagctgctcggctgtgggctcctgctcagccatgctcaagcttagcctgggtcgggacacctgtgggcgggacggtgacaggccttggacctggatccccaacggaggcgcacttctgagcaggagtgtgggctgcagccggagctccaaaagggctccaagggggccaccttcgctcctctccacccccgcgattcctgctcaggggcatcctctggggcagtgtgaggtgcccccaccccaggtatnaacatctaagacaaaatgggaactgcagccgatcatggggagagaggacacacctccccctccacgatggaggaggcagcagccccctgtatgtgtggggcggggctagcaggccccagaatcaaccggcggggcccacactaaaccctctcttagggtcttgccgctcttgagctgcccaggccctcgccctacggggtaacggggctcggtatccctcagtagggttgctcctctggccgtggtagtcacatgtaaacgtgtgtggtcggctcagcgtcatctttcaaacaggatgcccctggagctcggatgttaggggcagctagaataccgcacggggccacctggacacggggatcctaagtatctgcggtttctccacaattgtgaggntctgtgacctacaacttgggagctaccacagccactcagtactctcgggcccntctngtagatggtgggcccngagtgcccggggcagcactgacccggcaggggatctgtcaggctcagatccttcccggcagcgtgggaggtgggtcagggagcagcacacccgggacacccaggccggggtccaggccgccctgcttcctccaggggctggggcctccgcgccgcgcgaggatagccgtaggcgccgggatcctagggcgcggcccncacttccgcaggncccgcaatccgtgccgggcgtgncccgggcgctgggggaggccgngccccaatcnccgcgtcgcccccgaacgcgatggaccgcggctgccggcccggcgccncccgcgtccccaaggaggggccctcaggtctggcccgggccccacgngcctcggcggccatgaaagaagctccggaccgctcgggaggggccggcactcccctggtccccgccgcccctccggcccgggacccgcangtggggccggggccgccgccgcccggtcccgccccggccccgccctagcccgcaccgccctggcccgctgtcaccgcgcccccgcccgccgagaccctgccgcgggctcagggcggggcgcgaacaaaggcggaagcccccacctcagcgccccccgcnncnnnngnngnngccngncnnnnnnccnnnnnncnnnnncnncnnnncngncnnnncnncncnacnncnnnnnannngnngnnnnngccnngcnnnnnnnnnnnnnnnnnnnnctnnnnnnnnannnncgnngnnngcnnnnnnnnnnnnnnntnnnnnnnnnnnnnncacnnnncntcnnntnnnncnngnnggnnnnnnnnnnnngnnnnnncnncnngngnnnngncnngnnnnnnnngnnnccnnnnngnnnnnnnnnnncntnnnnnnnnnnnnnnnggnnnnnnnnnncntnannnnnnncncnnnnnnncgnnnnnnnnnnnnnnnnnangnnnnnncnnnnnnctnnnnnnnncnnnnnnnnnnnnnnnnnngnnnngngnnncnnnnccnnnnnnnnncnnnnnccnnnnngnnnnnacnnnangncnnnngnnnncnnnnnngnnnnggangcccgngnngnngnnnnnnnnnnncnnccnnnnnncagtcggtccgactgcgactcttgcttcggggcctagtcacctagtcccgnganttcggggaggtaacgggcacggggattaagttctngttaaacacgggcgagagcgntggcgcgcggnccgttccagggccttggtgtcccccgtggaaagacagggctgtggggctaggaggagccccttgcacgccccgcggaaagcngntgctgggcgagggcgcagcggaggtgtttttctccaggctgagacagaannnnnnnnnnnnnngngnngnnnnnnggngcaggcgccgntgcagaggccctagtgtccntgaggaatcccgcggctcctcaggaccaggaggcagggagctcctggcaccgtgagcagatgaggggctgcctcagcctgggcttcaccgcagagccntgttccccactccgcttgttcngagattccacacattcgcccacaagggccgtgttgaagtatcaggaacggccgcataacgtgagtggcctggcccagcagcagtgctngcacccagccccgggctcgcctntcctggaggccaagcccntaaatgccntgcaccagacactgggtgggacgctgccccgcgtccagcctgcagcacttgttaggactgtggactcgttaacgtggacgcctcttttatttatnganttgattatttttttgagacgtagtctcagtgtcgncccaggcttgagtacnatggcacaatctcggntcactgcaacctccacctttcaggttcaagcgattctcctgcctcagcctcccgagtagttaggattacaagtgtgagccaacatgcccagctaatttttgtatttttagtagcgacagggtttcaccatgntggccaangctggtctcgaattcctgacctcaggtgatccacccncctcagcctcccaaagcgctgggattacaggcatgaaccaccggggtgcccaatctttttttttttttttttttttcttcaagacagggntcttgcntcttttgcccaggnctggagtgcagtggtacaatctcagcttactgctgcctctatctcctgggctcaagcagtccttccacctcagcctcccgagtagctgggacntacaggtgtgcaacaccatgtccagctaattttttattttttgtacagacagggtctcactatgttgctcaggctggtcttgaacccctgagctcaagcgatcctcctgcctcagcctcccaaagtgctaggattacaggtgtgagccaccatgtccggccacccagcctcttttaatcactcttgagctccatgcagacagggccctgtctgtttggcccatactgccaggcaacccaggctgatcaagagaagtggagaccacacgcacacacacacgcacagctgctttgttcagacacagacatgaacacaggagggcatttttggggacagaactatgcaaaataccgagcttggtgtcttttgaaaatttctgaatgttggagggatatttgagagtttctgtaactgagtcacactgtcagtgccatgtcatcagcacangcgtttcctaatcaggtgtgaaatgcttcanctgttaaagactcagagcccctgtgcaggtgatcatgttgcccaactttccaataacccaagtgcttttaaaaaaaaactgttgggccgggcgcnggtggctcacgcctgtaatcccnagcactttgggaggccgaggcgggcggatcacgaagtcaggagatcgagattgtcctggctaacacggtgaaaccccgtctctactaaaaatacaaaaaattagccaggcgtggttgcaggtgcgtgtagtcccagctactcgggagggtgaggcanggagaatggcgtgaacccgggaggcggaacttgcagtgagtggagatctcgccactgcactccagccggggcgacagagcgagactctgtcaaaataaataaataaatacataaataaaagattcgattgtgtgggtatacattttgtttgtaaccattccagttggcaaatatttggtttcttttttgtccattatgaataatactgccataaacatttacgaatattataaaccattataaatgttgcattaagccttttcatgaatatgtgctttcatttctcttgggtagattcctgagtggaagtccccaaatgttttccaatgtaggtgtgccactttgcaccccctagcaacgctgggctgctccaggtggccacaggctcagncaatacctgctgtgcttgatcccagctgtacaagtgtgaagcagtgtcgtgtcacactgtgagtcgcacctgcacttccccaatgagtcttcctgggcagaaaccntatttaaatcttttgctcatttttaattgggctgtctgattaagctatgagtacttacatatcctgtatacagtcctttatcagatatatganggctgggnntgcagtggctcacgcctgtaantcccagcactttgggaggccganggcaggcggatcacctgaggccaagagtttgagaccagcctggccagcatagcanaaaaactgtctctaccaaaaatacaaaaattagccgggtgtggtggtgcacgcctgtagtcccagctattcgggaggctgaagcaacacaatcgcttgatcccagaaagcagaggctgcagtgagctgagattgccccattgcactccagcctgggcaacaagagcaaaactctgtctccaaaagaaaaagataggtgatttgcagacattttatgtggtttgtctttcattttcttaatgatgtcttcttaagggcaaaaccttttattctagtgcagtagttttttccacatggtgcatgcctttgctatcctaagaactcctngagctgaggtagngcggatcacttgagcccgtgatgtcgaggctgcagtcagctatgattgtaccactgcactccagcctgggtgacagagaccctgtctcaaaaacaaactcttagcccaaccggatattgtaaagattctctctcatattttttctgtgatcttctgctatattttatgtttgctgacatttagatatacagtccgtatttgggttaactttntcgtatggagtgaacatcttttctgtgtgtaggaacatccacctgtcctggcaccccttgttgagaaactatcgtttccccnaatgcaatgtctcaccacctttgttgaaaatttnttcaccataggccgggtgcagtggctcacgcctgtaatcccagcactttgggaggccaaggcaggcgcaacacctgaggtcaggagtttgagaccagcctgcccaatgtggtggaaccccgtctctactaaaaatacaaaaattagccgggcgtggtggcacatgcctgtagtcccagctactcgtgaggctgaggtgggagaatggtgtgaacccgtgaggcagangtttgcagtgagccaagatcgtgccattgcactcncagncctgggcaacnagagcaaaattccatctcaaaaaaaaaatttttgttcatgtaaatcgaangggtttattacaaaaattagctgggcatggtggcgcacacnngtagtcccagctactctggaggctgaggtgggaggatcacctgagcctgggaggtcaaggntgcagtgagctgtgatcatgccantgcactccagccttggtgacaaanggagatcctgttgctgggcatggtggctcatgcctgtaatcccagcacttngggaggccgaggtgggtggatcacctgaggtcaggngttcaagaccaacctggccaacatggtgaaacgtggtctccactaaaaaatataaaactagccaggcatggtggcacatgcgtgtaatcctagctacttaggaggctgaggcaggagaattgcttgaaaccgggaggcagaagttgcagtgagccgtgatagcgccattgcactccaacctaggtgacaagagcaaaactctgtctccaaaaaaaaaaaaccaaaaaaaggccaagtgcggtggctcacncctgtaatcccagcactttgggaggctgangcagatggatcacctgaggtcaggagtncaagaccancctggccaacatggtaaaaaccccatctctactaaaaatacaaaattagccgggcctggtggtaggtgcctgtaatcccangtactcgggaggctaangcagaattattgcttgnacctgggaggcagatgctgcagtgagttgagatggcaccattgcgctctagcctgggcagcagagagaccctgtctctcaaaaaaanaaaaaanaaaaaaaaanggncanaaaaagacagacagacatatatgtctttnncaatgctacgtcctaaaatgatggcatcacattaactggctttcttgcattactaaaaggatgaacttttaaaataattttgttatttaaaaaccttgtttatttttatttgttgagatggagtcctgctctgttcccgaggctggagtgcagtggtgcgatcttggctcaccacaacctccacctcccaggttgaagcaattttcctgcctcagcctcccgagtagctgggactacaggcacgcaccaccatgcccagctagtttttgtatttttagtagaggcggggtttcaccatgttggccaggctggtcttgaactcccgacgtcgtaatcctcctgcctcagcctaccaaagtgctgggattacagatgtgagccaccgtacccggccagaaacaactgttttttaatttttcttttgagacggagtctggctctgttgcccagactggagtgcaatagtgcgatctcggctcaccgcaacctccgcctcccaggttcaagcgattctctcctgcctgagcctcctgaggagcttgggactacaggcacacgccaccacgcccagctaatttttgtattcttagtagagacggggtttcaccatttaggccaggatggttttgatctcttgaccttgtgatcgcctcagcctcccaaagtgctgggattacaggcgtgagcccctacacccggccgaaacaactttttaagatagaatctatgttgttcaggctggattcaagttcctgggctcaagtgatcctcctacctcagcctcccaagcagctgggactataggcatgtaccacttcgtccagcttcncggctttttccatggttgtaaactgcctattcatgttcttggtggtaaatgtttcccaaggttgtttgtcttgaatttgtgagattgtctgatttgcagaagtttttgtttgagagtcttgctctgtcacccaggcagtacagtggcacgatcttggctcagtgcatcctccacctntggagctcaagggatcctcccacctcatcctcccgagtagttgggaccacaggtggcaccatcatgcccagttaatttttttctttttatgttacagcaatgagtctgggtactttttgcattttttaaatgttttttgtagagatgggttttgccatgttgcccaggttggtgacttacagaagnttttttttttttntntttttttttttttttttngagacggagtctcgctgtcgcccaggctggagggcagtggccggatctcagctcactgcaagctctgcctcctcggtttacaccattctcctgcctcagcctcccgagtagctgggactacaggtacccaccaccacacctagctaattttttgtatttttagtagagacggggtttcaccgtgttagccaggatgatctcgatctcctgaccttatgatctgcccgcctcggcctcccaaangtgccgggattactggcatgagccaccgcgccncggcctacagttttaaaaagtccttactgtcctgcaaagatagggactcttttacctaacaataccatgaacacacccaccaaaactgacaatgctttctgacatctaatagtctctgctcaattttccccaagtctcttcttgcaattgtgtccccacatcagaatctggacagaggccgtgctgtgcactgggatgcccactgcctctatttcctcttctgcgcttggtgccacccaggcgtccaggagccagtgtgttttgctgacaatgtcctgtgttctggatttgctgggctgaaccctccaggtgtcctgtgaaccctctcccatcctctgcacttcttaggcaggatgagcccagttcgagttttagaggcggtgctgggggcctcctgctgcttcacgtcattggacttgtcttctggtcctacctgtagtgaggtatggttggttctgggaagctgggctggtccacccattatcagtggcctcctcaactgtcatcttcaattttcactgtttctcacatgcatcattttattggacacttcaaagtggtgattttctaattttgggtgtgttttttttttttttttttgagagagtcttgctcttttgcccaggctggagtgcagtggcgcactctcggctcactgcaaccntccaccntcctngagttcaagtgattctcatgcctcggcctcccaaangtgctggagttacaggcatgagccaccgtgcctggcctgattttctaattatttctgtatttcttagctggaattatttcttttttttttaaaggacccncgtcatcaattgttgccccaaaattatagagttcatacagaaaagacaaattaaatgcccgattctttccttttatttgccaatttttatgagtcagtgccttacaacttccaaaggtaaacatgaggcttctttccttaagcatcatcatgaactcttagatgttcatttattcaacacaaactaaaaaaggaatgttaagtcttaagatatcattaatactaacttgcattacttgtttatgaaggattaatatactaaatagaatatatgctcacatttttatatgtagatattaatttacaagtaattaacatgctaaaacattttataattcgcttcaataacgtgtatagataacnacaaaaattaactctggcctaccttaggctacatgatcacagacaagctgatgtaattaaaatgagaagatttatttcttggtactttcatggctttatttttacattaaagtcttttatgatgtattatttattgctatcttccaccaaatgcttggccagtcaatcccagggtgatcttaataataacaactaatacatgtaaaccataaacatttatgaaaattatatatcctcatataaatttcataacatatgtaagttacaaaagaaagaaaaagtcaacgaggatatgggggaagccaaaaggaatacaaactaacaaatgaacctaactatgtacaaattatgcaaatcacataatttgcaggaggtggaaagaaagaaaagaactcatctaggcaacttttgaaaccagtacttagatgctacaggtcaaacacaaaaacaacagtacacgattaaggaagtaaggtgcctccatagtgactgcgcctccctggggcacaggttgaacagttcacctacagcactgacatggcctaagcgaatgtcctgtcaatctgagagccaggtttctccctgtcacaggaagaaactacacataagngaaaggggcaggtgagacaggaacagcaggaactagacagctacagaaaccaacagggcgggtaaatgcacaagcacgtgtcatagatccacttcccagctctgtcccaggagggcccagaagcaacaagcacagccagtgcccaggtcttggttgctaaatcccagtctccagtgagggagggctccctggagaagcagctgggtgcagagctgggacaaggaaaactgaagacatcccaaaataaacaagtgcttaaataaggatagggcacaggagacaatctccaggagctcccaatggccaaagcgtggaaacagtatcagattatgactcacagaatccaacaaacagcccttgcgttcatactgatatataaagaaagaaatcgtaggtcaggcgcagtggctcatgccttttgggaggccaaggcgggcggatcacttgagctcgaaaatttgagaccagcctgagcaacatgggtaaaccccatctctacaaaaaatacaaaaagtcagctgggcatggtggtgagcacctgtggttctggttactcaggaggctgagatgggagatcacgtgagcccgggnaggtcgaggctgcagtgagccgtgatcgagccactgcactgcagcctgagccgcagagcaagaccctgtctcaaaaaaaaaaaagggaaaaaagctgaagggactgctctttcttagagatgaattccaattaataaacgtcaaaggaatgaggaaaatgcaaaaatcacctttgaaaactaagttaataattactgcattgcaagacccaccagtggatgctgaaattaattagtgggtaggccgggcacggtggctcacgcctgtaatcctagcacctngggaggctgaggcaggtggactgcctgagctcaggagttgnagaccagcctgggcaacacggtgaaaccccgtctctactaaaaataaaaaaaattacctgggcatggtggcgcgtgcctgtaatcccagctacttgggaggctgagacgggggaattgcttgaacctgggaggcggaggttgcagtgagctgagatggcgccattgcactacagcctcggcaaaagtgagactccatctcaaaaaaaaaaaaaaaagtgggtaaaacttggaagtgaaacagacattcacttagtctggaagtatctccccaaggtatttatggatgacaaagggaaaacagtaactatgtaggggagaagccccggcagccgctgncaccacctgaactaacaggaccaggagttggacagactgacattgcatatctccactatgcattgagaagatgacatcccagctgtggtattcatgccaaaaaataaaataaaccagcagggcgtggtggctcaggcctgtaatcccagcacttttgggaggccaaggcggatggatcatgaggtcaggagttcaagaccagcctggccagcatggtgaaaccttgtctctaataaaaatacaataattagccgggtgtggtggcgggtgcctaaaatcccagctactcaggaggctgaggaaggagaatcgcttgaacctgggaggcagagattgcagtgagctgagatcacaccaccgcactccagcttagaagacagagaaagactccgtctcaaaaaaaaaaaaaaaaacnaaaaacaaaaccttgtccagtcataaggtcagagtccccagtgtgagggacattctacaaaatagctgagagtaccctttaaaagtgtcaaggtcataaaagacaaaagcttcnannaatcnnaatnnannnanannncttcnnaaaattcataaatagagaaataggctgacattaataggctatgttcggtgtggtggctcaggcctgtaattccaacactttgggagaccaaggcaggaggatccctggagcacaagagttcaagaccaacctgggcaacatagtgagaccccatctatacaaagttttaaaaatcagccaggcgcggtggtgggtgtctgtagtcccagctactaaggaggctgaggtgggagatcccttgatcccgggagttccaggatgcagtgagctgtgtttgcgccactgcactctagcctggacatcagagggagaccttgtctcaaaacacaatttttcaaaaatttangttttttaaaaaagatattgagatgctacaatgtccatttcaggaagaatatcatagcacttttgagacaagtttctttttttttttgagacacagtctcgctctgtcacccaggctggagtgcagtggtgcaatctnggctcactgcangctncgcctcctgggttcacgccattctcctgcctcagcctccccagtagctgggactacaggggcccgccaccacgcctggctaattttttgtatttatagtagagacggggtttcaccatgttagccaggatggtctcgatctcctgactttgtgatctgcctgcctcagcctctcaatgtgccgggattacaggcntgagccactgcgcccagcctgagacaagtttttctacaaaatgtaatgacattaaggtaatatgaagagacatgatcctcatctttatgtaactggagttcaggtattcattacgctcaacaatatcaaccttttatgatgctattttgttgaatgtgatgaatgccactgataataggacatttaattccatttagaatatctgtatttccaagtaaagtcctaaatctgccagggtggagatttatccatggtaaagtctattcaatccagatataaaaaagatagagattgagggccaggcgcggtggctcacacctgtaatcccagcactttgggaggccgaggtgggcggatcacaaggtcaggagatcaagaccagcnctggccaacatggtgagaccctgtctctactaaaaatacaaaaattagctgggcatggcggcacgtgcctgtaatcccagccacttgggaggctgaagcagaagaattgcttgaacggggacccgggaggcagaggctgttgtgagctgagattgcaccactgcantccagcctgggctacagagcgagantctgtctcaaaaaaaaaaaaaaaaaaaaaaaaaaagagagattaaagacatttaaaaaaaagattacaaagaagaaactgcaaagcaaaatcacaatgagatattacttcacacccagtaggatgactaaactaaaaaaggtaagtgttggtgagaatgtggagaaattggaaccctcatacattgctggtagaaatataaaatgctgcagctgctttggaaangtctggcagttcctcaaaaaattaaacagttacctcatgacccggcaattctactcgagaattgaaaagatgttaatataaaatgtatacaaaaatgttcacagcagcattattcttataaagccacggnagtggagacaacccaaatgtccatgaacagatggacaaaaaaaaaatatgcggtatatccatgtcagtagtcggccataaaaaggaacagtcttagacatggtacagcacagatgcaccttaaaaatgctggctggggacaggcgcagtggctcacacctgtaatcccagcactttgggaggctgaggcgggcagatcacgaggtcaggagatagagaccatcctggctaacaaggtggaaccccatctctactaaaaatacaaaaaactagnctgggcatggtggctgctgcctgtagtcccagctactcaggaggctgaggcaggagattggcaagaacccaggaggcggagcttgcagtgagccgagatcgcgccactgcactccatcctgggcaacagagcaagactctgcttcaaaaaaaaaaaaaaaaagaaaaagaaaaaaaaaataaccgggcaaggtggcaggtacctgtaatcccagctacttgggagactgaggcaggagaattgcttgaacccaggaggcggaggttgcagtgagccgagattgcgccatggcactccagcccaagtgacaagagtgaaactccatctcaaaaaaaaaaaaaaaagaaaataaaaaaacttgctgggcgtggtggcatgtgcctgtggtcccagctacttgggaggctgaggtgggaagattgcttgagcccaggagtttgcatttacagtaagctatgattgagctaccacactccagcctagagagcaagaccctgtctcttgaaaaaagaaacccggtcgggcgcggtggctcacgcctgtattcccagcactttgggaggccgaggggggcggatcacgaggtcaggagatcgagaccatcctggtgaccacggtgaaaccccgtctctactaaaaatacaaaaaattaagccgggcgtggtggcgggcgcctgtagtcccagctactcgggaggctgaggcaggagaatggcgtgaacctgnggaggcggagcttgcagtgagtggagattgcgccactgcactccagcctgtgtgacagaggaagactccgtctcaaaaaaacaaaaacaaaaaaaaccataggctgggcgcagtggctcatgcctgtaatcccagcactttgggaggcccagctgggcggatcatgaggtcaggagatcgagaccatcctggctaaccncggtgaaaccnccatctctactaaaaatacgaaaaactagctgggcatggtggcgggtgcctgtagtcccagctactcaggaggctgaggcaggagaatcgattcaacccgggaggcggaggttgcagtgaggtgaaatcatgccaccacacacgtctgggaaacaggaacgaaactccatctcaaaagaaaaaaacaaaaaacgaaaaaacaacctctaaaatgaaagactgtatccctagattgctgagaggtaaatgaaatgtatgtagaacatccagcagnaggtgcagcctcagacactggctgaccatttgtgcaacctgagagaggcgtgctcttgcagcttgagttccaaccatgccccacactccactcccnattaggctacactgcaacctatcacttgtatgtttcctatattagaccatcagttcactgcatgttaagaaccaaaagttaccatttacatgacaactctgnttgccaggtacagacatagccatctcatgagatctaaaaggatgtctgagagcaacactgtagccctttaacccacgtgaggctgaacaggattcaatcagctgcccagtgtagactgctccttagatctccgtgcacaccagccagaaaccagagcactgtgggagcgtgtgcacgctcacatccgagaccctctccagggacctcaggctgaagacggagctgggcagaccatgagccaccctggaagagctccaagtcccacaggaatgctgcctctcctgcccggggctggccagttcctactctcagcccatgccggccagggaaagggaccaggaagaacagggcttcccttttctccccaccctgagtgtaatttcgcttgtcgacacttaagtcatgtgtccaacctgggccaatccctgtgctttctttttttgccccgagatggagttgtgctctttttcacccangctggagtgcgatggcgcgatctcggctcactgcaacctccacctcctgggttcaagcgattctcctgcctcagcctccggagtagctgggattacaggtgcatggcaccatggaaccacaggacagccagaggcagagggggttccccanagtgcccatggggcacaggctgccagttcagtttgtcagccatagctcgctgtctgagcaaagcatcactcagtcaccatgtggggggcagcagggcactgggcagtgtggagtgtccgccctgcaaggccctgtgcccggaggactggcagcancccttcnagaggggaccagacagcccagctggccnaggcctcatgtctacttgctgtctgtgcagtcagtggaagagccctgctcttctttctctcacaagcaccctgctggaacaataaattaaatagtcctctggccttggaagtaaaataaggttttgtgttttatgaataaggaaatgaagattgggtatgatgaggctcagcccagctacctgacctgctgcccaccagaagccccgngtggcttccagacccagcctctatcctagttataaatggccagccccacctccaccacaggcacagaatcaggtcattctcctttgaccactcggcagcacctgcctcaatgaccccaccactggccccccagcaaataccagctgttgcttctatgacatcattctctctacttcctttacctccaaccctcccaagaccatgccacatatggacacgacttcgacgtgtccacgtgctatcagctgacaaactggagaggtccggctctaggcaacgctctcctgcgggccagctggtgcctctgcccagcctgtccaatgctgacgcccctcagctggctccttcctggggccttctctccagtgacacctacccacccagttccccaaggcctcatattacttcattcccatgcccctcactcccgagaatgccaggaagtcccaaatcctggtcattcctccctccaaatgcctgttacaccactactgcacaaccaaagcaatgctgcttgtcagtcctgtcatttgtcacaccctgcaggggctgaccacaccagtccatcaggtgccctctccacttcctaagcagcagggagccagtcctagcacggccccagagagcagaccccctgcctggcatgggcctgctcaggccttgctccaacaccgaggcccgggccaagggcacctgcttggggataacctgactctaactcactgcactggtgacattttctgtcacattcacagcgactacagctggggacttagtaatcctttctcctgctagactgggcttctggaagggccaagattagtcatcctgttcatctgggttcctagactgtggccctggctggcattgggcaagctgcttagatggcagctgctgatctgtagtgacatctgtgaccgacagcgaaagaaccaccncttagtcacactcccttgcccatgactcagccaggcccatcccagcgtggaagcaagcttagcctgggatgtgtgcccgcaggagccgctggtgcagggaaaggtttctgcagacacggcatgcattcctgtctgtctctccnactaccactgcccactgccctgggcttccttacatcccagctgtgggacagtggggtcaggcagaactctggagctcccttgtcccccttcccatctcattctcaaagtgctgtcaccaacccagcatcagggggcacaaggctctctctccactgcccagcttggagtgcagtggcatgataatggctcacagcagcctcaacctccagggctcaagcgatcctcccacctcagcnctttagaatagctgagaccacaggagcacgccaccacactcagctaacttttgtatttttagtagagatagggttttgccatgttgcctaggctggtctcgaacttctgggctcaagagatccttctgccctgacctcccaaagtgctgggattacaggtatcaggcgttgccctactcctttttgagacggagttcactcttgttgtccagactggagtgcaatggcacaatctcggctcactgcaacctccacctccctggttcaggcgattctccagcctcagcctcccaagtagctgggattacaggcatgcaccaccacacccagctaattttgtatttttagtagagacggggtttcgccatgtngnccaggctggtcttgaactcctgacctcaggtgatctgcctgccccagcctcccaaagtgctgggattacaggcgtgagccaccngcgcccnagcncgccccactcttaaatggacggattatcacagcttccaccagccacttcatcaaatatacaactaagagaggatcctncatgccttgctccgnggcaaggttaaaaacaacaacaaaaaaacaaacagaaaaaggaattacactacaaagtcaaaactgctgaatccacgtttctctgaaaaccagagtacaagaaggaaaggaacagcccagagatgttctggctgtgggaagcctgtggacggcacacagggcagccatcccaccnccaacctcccctcacctggaggcacaggcacaagggtcaacaggtggctcccgggcaaaggtgtcctcccacctggtgagttagagaggaaggtgttaggtgtgaggcaggaaagaagataagaaagaagacaggcagcttcggccctccaggagcggggaccccccgccacnccccacaacccatgccaacttcaggtgtccaacaccagatggggctgctccctccatccccaactcaggttctcccaccccctcccagctggacagacaccaaaatcctggcccaggcctggactccaacagtgggacgaatcaaacagttccagttctacacacatttctattttattatggaaaaggtggaaacgccacncttctccacaacagcaaccagtaaaatttatcccaaaaataactcggtacaaaacaggtctgtttcagaattaaaaaaaaaaaaaaagaaaaaaaaaaaacctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccatctgaancacagaggagaaagaggcttgcattcacaggcggcctgctccccactgcggctttgaccaggcccccagctggctcccccgggactcactctcgcattataggcgtccagctgggcatccagctcctctgccgaaagctgctgctttgaattncctgccggcacctctgcctcttccacgggcgcctccgcgggtgcctctccgggtgcctccaccaccaccaaaacctccagcgccacggtttctagtcatgccacctctgtttacgctagcaaggaagacgaaaccgttcacacacccggaaggaccctaagagcgacgcagcctcacccntcggccaatccccttccccagaggccccggaagtcacctctgtgcaggcctccgctgtgcgtcaatctgtgacgtgacaagctgaatgttcatggggcggcctgcggcaaagaatacgagaaggcacgttctattgagaggnctctgaaacccacccagctggcgccacaccctggtctccatgcaaacactggaaagggcctctgtgcgtctcaaatgcccccgacaagggaaatggcctggagatactggtgggagaacaaaatggcaaggaagcaaccccaccaacacctcctcactccttctcagtccagactaggtgggctgctcgctgaggtatcggggtgctcgtgggtggaganggtgtgggtgacctgacgaagaagaaccggtacctttgtctttacgactacagccccgcactcagaggtgtactatggcggttctgagaaggcttcacagaagtgaatcttccggaaggagctgaaggaggggagggatgtagcttgctggatgggggttcacanagaggttggtccagatgtgtggggcagcatgagaggtggcagatggaagagagagacaaaggggcaaatgcaaagtgtcctcagccacaggggtaccccatattcctacctggacaggtgccagccccaaactccacanagccccacagtcagcgtgggtccacccccagactcaccatccagagggacgccgttgtactgcttcatggncttcagggcatctgccttccgctcaaagtgcacgtctgctgttcctaagctgcgaccagagcgatcatagtgcacagccgccttcttcagcgttccaaattcagcaaagagttcctgggagttgcagagagcagttgtcagaaaagcaacaaaactgcgttccttctggtggcccagggacaggccctggaagcgtgagttgctttgggggtggttctctgggaggcaggacagtggttaacgggaaatgagggaagggcggggcaggagggacagcaacttccaagagcacctgggtctgagggctcctgccattgtggggacctgacacgtgtaccacgatgcaggtagaggaagctgcaaagcccactagcaacgggcacaaaattaagccactatcctcttcaacaaaggaaaatgtacaacacanccncaagggctgttccaagaaacggtaaaggccaaaatcaagagcaagggaagcagtccgatatcagaccagcttgaagggcctgtagattcgggagccctgaccccagcccctcccccaaaggcagattctggctcacctttccctctcctcctactcaagcctgcggcaaagtctgaagtcaagcgctgtcatggaaactgccctgacctcaggcaggctgggagttggagagggaacccagagtgtggggatactccggccngcaggcacacagcgggaactggagttcaccaaaagcggtttccagtnggatgctagaaaccaccttaaaaaanagtgttgagacactgtgagtgctcactggccctactctgtcctcccaaggcaaatggctgggctgtgggcaactgaaccctgcccnagccatctccaaaactgattcccaaaaagtcatttcttaaccagaaaacaagttgaaatgccattgggattcaatttttctttttttaaaaaagaaaagcttcaaccaaagatggatttgagagtcatgtcactgacgggacacggcggtggggagtgataaaaccacangcgtacaaggntctttataagacagtactcaaggcaaacagagccagaaaaacagactccctgtgcttcacaagatacataaagaagattctttttctcacattaacccactaagacaggcacaaaatttaaaaagcaactgggctgggtctaacagccaaaaaccactcacatttggtcagtctttgtccctgnttagaaactggaagccctggcaggggattttcactcacagaacccatcnttcagactaacagcagcagttcctcaggctcagctaggctcgcacctgcctgcgcactgaccccggctttactagcactgggtctgtcctgcagcccttcagagctgggagggctcccttcgctaaggcgggaaggggactcagggccacatccccaaaatcacgatccgtcctgtgcagggcgaacggctcaccgagaagccctcgtctcttacctgaatatcggcgtctgagactccaaaatccagattggacaccagcagtttcccacctgtctccacgccggcaccaccgccgaagccactgtcgaaaagatcgtgctgccacttgtcgggaagttgttttnggctgaaaaaaaaaccgcaacaagagcagatctgtgagtctcagtccagggctttcctgaccctcacggctactccggacccttcctcttcccggcctgagaggatccggccgaaacggggccgccagcgctccctccggcgctgcagctgccccagcccgaggccgcacggtcccaccgcggccgcacaacttcagttcccttagactaacttcccgccgcctgtgccgcgcccagcgtcccctcctctcctgccacgaggccccaacgtccggaacaaacaaagagctgggaagggtctcagcctccgggaccggaccccgaaagaacgacctcgctccngnccacnaccccctccgcgcccacacgcaccctccggacctccgggcggccgctccaccagccttatccacccgccggcccgggtctccgccgcgagcggccccggccccagccccggctggccccctcccactctccggngnggncggcctccgcactcacccngntgnagggcgccggtcggttcctnccgnctccgccggcnncgccncgggcgatggccggncggtnncngatgnnccngncnnctcgattcantngcncgnnggcntgcgccccaccnnngnggccncnctggnanccgnncngncnnnnnnnncnncnnnnncnncnnnnnnnnnnnnnnnnnnnnnnnnnnnnnnnnnngtcgtccagagacangtccattnngtcnnccatgncgggcgcgnantcnggcatcggctcgagcccgcgnntcagcacgccngcacgtcacntcnggcgcngcgtgaggcctnccggtgccacggcctcggagcggctgctgattggccgctggcggacggctgcgcncgcgggacggggtgaggcggggaggcgcgtgcncactggcgtgcgagactcggcgggcgctgttgagggagtcgggccgcgactgtggtcgtttttataccttcccgcgcggacgccggcgctgccaacggaagggcgggtagggcggtgcgtgattaggttggcgaaggtgcgagggcgcagggggtggggcggcggccgttggaggcggagcctacgcgcccctccctccccgcacgctccgcccgatcggccagggctgggggcgctgggggcgctacgggcgcggcgggtgcctgggagctgctgggagtccttgtttccgctcccgcccaggactgtgcgctcggctcgcggtggggtccggcgggcgcggcttcggcgggcggcagccgctgcagacgagctgcgggttggttttttggtctccacctgcagcccccccaagtctgcactgtcacattttgccagtcatatcctttacaagttttcttgcgggccgggcgcgggcctcacgncctgtantcccagcactttgggaggccgaggcnagaggttcgcttcagcccaggagtttgagaccagccggggnnacatcgtgagaccncnatctctaaaaaaaaanntgagctgggcatgntggtgcnctnctgnactancagctanntnnnngnccnagnngngnnnnntgcttgagcccaggaggtcgaggctgcagtgagnccgtggtggcaccactgcactccagcctgggcgacagagccagaccctgtctccaaaaaaaaattatttttgcaacttattaatgaaaaccnagtgtgccatttcattgattttttttttttttttttgaggcagtctcattctgtcgcccaggctggagtgcagtggggcgatctcggctcactgcancctctgcctcctgggttcaagcgagtctccagcggcagcctcccgagtagctgggactacaggcacgtgccaccatacctggctaatgtttgtatttttaatagagacagggtttcgccatgttggccagggtggtcttgaactcctgacctcagatgatccgnccgccttggcctcccaaagtgctgggnattnacaggcatgagccaccacacccagcccatttcatggattttaagttgttttgagatacttgcttttgtttttgttttttgagtcagggtctccctccgtcacccagagtggagtgcagtggtgtgatcttggctcactgcagcctcaaactcctgggctcgagctatcctcccacgtcagcctctcaggcagctggtgcacgccaccacagctggcttttttttttttttttgagacagtcccactatgttgcccaggctggagtgcagtggtgcgatctcggctcactgcaatctctgcctcccaggtccaagtgattcctgtggctcagcttcccgaatagagctgggagctggcgtgatctcagctcgctgcaacctccgcctcccaggttcaagtgattctcttgcctcaccctcccgagtagctgggattacagttgcccaccaccacacccggctaattttttgtatttttagtagagacagggtttcagtatgnttggnccaggctggtcttgaactcctgaccttgtgatctgcctgcctcagcctcccaaagtgctgggattacaggcgtgagccactacgcctggcctctaatttttgtttttttggtagagatggggtttcaccatgttggccaggttggtctcgaactcctgacctcaagtgatccaccctcctcggcctcccaaagtgctgggattacaagcatgagccaccacntgcggcnaattttnttgtattttttgtagagacggagtttnnnnatnnnnncnnnnnnnnnntgagatctttgaagatatcctcaacgtgaggtaaaaccaaactcctgantgtcctgtgctcccaaatgtgatctccttgtccgtaaggagctgagtcccttcccttggagagaagagtgtgccctttctntanatggctaaagaaacctcacagatagttcnnttttttccnttttttttttttttttntttggnagagactcagtctcactgtgttacacaggctggtctcaaactcctgagctcaggcgatcctcccgagttggcctcccagagtgctgggatcacaggtgtgagccacaaagcggattgctgctggggcttgctgttctcccgtagctcccctgcagccctgaccctctgggcccagagccctttacttgttatttgttttaatagaaacggggctcatagcagggcataggggttcacgcctgtaatcccagcactttgggaggccgcagtggcagatcgcttgaggccaggagttcaagaccagcctggcctancatggtgaaacctcgactactaaaaatacaaaaattagtcgggcgtggagtcacgtgcctatagcctcagctactcaggaggccgaagcacaagaaatgagctgagatcatgccactgcactacagcctgggtgacagagtgagactctgtctcaaaaaaaaaaaattaataaaaataaaagtaaaataaaatagaaacagggctcacgatgtttcccaggctgggttcggactcctgggccggtatgatcttcctgccttggccccctgagtagctgggactgcactgtggcaggcttatacctgtgttggtgcctaaacgttctagctctgcagactcaatttagccagtcgtcctgttccctccgccgcaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcctcccgggttcaaacggttctcctgcctcagccttccaagcagctgggattacaggcatgtgccaccatgctgggctaatttttttatttttagtagagacggggttttgccttgttggctaggctggccttgaactcctgacctcaggtgacctgcccgcttcagccttccaaagtgctgggattacaggtgtgagccactttgcctggcccacatttttattttcttttctttctttcttttctttttttttntttttttttttgaganggagtttcactcttgttgcccaggctggagtgcaatggcgcgatctcggctcactgcaacctccgcctcctgggctcaagcgattctcctgcctcagccttccaagtacctgggatcacaggcatgtgccactacacccggctaattttgtattttttagtagagacaggctttctccatgttaggctggtctcgaactgtcaacctcaggtgatccacccgcctcagcctcccaaagggatgggattacaggcgcgaaccaccgtgccccccccaacattttcattttcatctcatgaagaaaagttgatagaaaaaaagccaggtggttggtacccatngtttatataaagatcctgtcacagactccataggatgaaactcagctgtgaaatacgtgggattaaaaagagattanagtctgggcgggcagatcacaaggtcaagagatggaggccggcatggcggcccacgcctgttattccagcactgtgggaggccgaggcgggcggatcacaaggtcaagagatggaggccggcacggtggctcacacctgtcatcctagcactgtgggaggccaaggtaggcagatcacagggtcaagagatcaaggcagggtgtggtggcccacacttgtcatcccagcactgtgggaggctgaagtggatggatctcaaggtcaggagattgagaccatcctggccaacatagtgaaacgccatctntactaaaaatacaaaaattagctgggtgtgtggcgtgtgcctgtaatcccagctactggggaggctgangcaggagaatctcttgagcctgggagacgggggttgcagtgagccaagagcaagactccntctcaaaaaacaaacaaaaaaaagattagtttaaactttttatttgaaaattctcaaaattgaatggcataggccaggcgcagtggctcacacctgtaatcccaccactttgggaggccaaggcaggcggattgcttcaggccaggtgttcgagaccagcctggccaacatggcaaaaccccgactctactaaaaatccaaaaaaattagccgggcatggtggcaggtgcctgtaatcccagcactttgggaggccgaggtggatggatcacctgaggtcaggagtttgagaccagcctggccaacatggtaaaatcccgtctctactaaaaatacaaaaaagtagccgggcatggtggtgcatgcctgtaatcccagctactcaggaggctgaggcaaaagaatcgcttgaacctgggaggcagatgttgtggtgagccaagatcgcaccattgcactccagcctgggcaacaagagtgaaactccatctcaaaaaaaaagaaaaaaagtggaaatgtttgattatgtttaggttgaaagcagagttttgcatcagcgaaatggtttttcatgagaccgaaatgagcgtaaagcagaagcaagggtcaaggttttgcccagggaggacaagaagaactccccagaggacagtggggaatggagaggacagtggggaatggggaggaccgagaagctactcactaccccaagtaaccaggcgtatttttgtagggccaggtgcatgcccatattgattgacagggtctcactgtgttgcccaagctggacgtgaactccntgggctccagccatcctactgtctcagcctcccaagntagcataccaccacactcatctgcctcctttgcttttttttttttttttttttttttttttttttganananagtcttgccctgttgctcanactggagtgcaatggcaccatctcagctcaccgcaacccccacccttntgagttcaaaggattctccggcctcagcctcccaagtagctgggattacaggcatgcaccaccacagccagctaatttgntgnatttttatttttatttatttatttattttcgagacagagtctcactctgtcaccagggctggagtgcagtggcacgatcttggctcactgcaacttccgcctccctagttcaagtgattctccntgcctcagctttccgaatagctgggactacaggcgctcgccgccatgcccagctaatttttgtagttttaacagaaatggggtttcaccatgttggccaggatggtctcgatctcttgacctcgtgatccgcccacctcagcctcccaaagtgctgggattacaggcatgagccactgcgcccagcccttgttgtatttttagcagagacagggtttcaccatgttggccgggctggtcttaaaactcctgacctcaggtgatccgtccacctcggcctcccaaangntnaccaggattacaggtgtgagccactgcacccngcccctngtctttgcttcttaaggtgaaattgagatgactgaatcttagtacaattttttttttttgagacagggtcttgctgtcacccaggcggcagtgcagtgtggcaaaatcatagctcactgtagccttcaattncctcagctcaagtgatcctcccacctccancctctcaagtagctgggaccacaggcatgctccacaatgcctggctaattttttatttttttattttttgtagagacagggttttgctatgttgccaaggcntagtcttgaactcctgggctcaagggatctgcctgccttggcataccaaagtgctgggattacagacgtgagccaccatgcctgaacaaaactacataaatttttaattttttttgtggaaatggagtctcactatgtttcccaggctggtctcaaactcttggctctgtcctgccacagcctcccaaagtgctgggattataggtgtggcgcctggcccgtacaaatactttttattctaggcttaacnttttacattggccctagctaaatagaaatctcatcactcaggaattaatcctcatttaatcaaacngggtagnggtgtaatcttaggaaattattgattgactctacnctgattggatttgtagttaatagctaattagngttaataactaaattcacaaggcacagttttatttgatctcttttaaattgctcttaaggatgtaacaaagagtgcgtgggatgccctgagggcaggcattcgacttctggagcagcagcttaacttctgaaattcctccngaaccatgtgtccacacctcgtctggctgcatccgtgggccagatgtgggtggtgaatcctgtggattagaggtggtgctaggtagcccccaagtgactgcagtggtgggtccacaggcagcctgcagagcccgccctgcagcatgccagctgggcctgtgatggggcatccagagggtgttgccctgaacactcagcatgtctccgctgacacagtgtgctcaggctttgttaacatggggcctgttggctgcagagactcaggagttgagagtctaatttttggacctgctgatggttaagtcatagtgagtcagtgttaacgcgcaaagcgtttgacgagtccaatgntgcttccatactaagcagcaccaggtttcttttgctaaaattgaactcctgtgaaaaattcagagtgactaagttcattcaacaaagaccgtgggagcccgaggctggtaaacaatgagtccatcccgcatcccaggggactctggtggcagtgcagttttgccgagaggagttttaatttaaaaaaatgcaatcaggagaccagcaggtcctggaatgagtcaccctcagtgcatctgcggactcatcagacaccccaggccggcttcgggtggggaatgcactagaacgaagtgacacctttgactaaacngaggcctcccccgagtactcagagtggcccagacccctctcctcagggggctagcaggcttcagctctcatttgaaagggccgatatcaagcagagttgtgctgaggccagaaacccccacgggcaggtcctcccagggnctgggagtgggcatgccgtggggccggcgctgccaggacaggagggtggccacgagctccagctccnacaatgccaggccgaccctgccgtnggggctggggctgggacttgctgtgctctgttggcagncagctgttcctcagggngtttccaggctcttggagatcagggacactcatttnctcttgatcatggctgatacaagcatccctctctgtgtcaggtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctagngtccccagaccccacccctccntgcccttgatcnaagagaccagttcactactcagatgcacgtctccttggtgccttgaccattcatgtgacctttttggcatcacagatcaagtgtctgcagatgggcccagggcctgtaggtcagacattgnccnctttttccccagcctcaagcacaggggacacagggtgggctaggccagagcgccacctcctcagagaggcccctgggctccccactgagcatgatgagcctgggtgaggggaggcgcctgctgcggttgccccgggtggaggccgcatgtccggtgtccncttggtcattgctggntcttcgcctgggggcgggctggtcaggagaccgattgggtaacactcctgatttcggcttctctgaaacatgagaggctgcagtgctggagccactgcccagggtccctacctgcacccctgcctggcttgtcacatgctcntgtgtccagcctggtcatgcctgtccttttccccacctcccctccgntaggcaaggtgcccggcgacgactgcccgctggtgtggggccagtgctcccactgcttccacatgcattgcatcctcaagtggctgcacgcacagcaggtgcagcagcactgccccatgtgccgccaggaatggnaagnttcaaggagtgaggcccgacctggctctcgctggaggggcatcctgagactccttcctcatgctggcgccgatggnctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcnggtgtgttttgatatgaaaactctcnatgaataaacatctccgtgaaacgccaaggnccctcgtcaaaccctgagtcatgactgggaggagnaaggagcaggatcagacggtagagcctggggcatgctcttcaggcatgctcttgcctgctggattgccggcggcggccctgggaccctccctcaggctggctctgagggaccctggctgtgcaaagctggcggccactgcttgtggcgcctccagactgaaggccaccatctctgagtgggcgtccattgttctcactgggactgtctgcagcggggctgggcctcccacagtgtagggatcagtgtcctgacactgggaagtgtgtccacacgtctgaggcttcccttcctagggaaaggtggcccntgggaggctcctttgtgtgcctctgctccccnacaatcgtggtgggaaggggccgctgggggagtggcagccccggcatctcaggctgcttctggacagagcacaggctgtgtctccagtaacctagggagcccttggcattcatggggccagtgacccgtgcccagtgtctcttgacccttcctcacagcaacctgaggagtagaccaggcctcacctgaaatctgtgtcagggttctctagagagacaggactctatatgaagagtatatatgaagagtttattngggagtattgactcacgtgatcacaaggtgaagtcccacaataangccatgtgcaaggtgaggagcaaggaagccagtctgagtcccaaaacaaaagtagagaagccgatagtgcagccttcatcctgtggccaaaggctgcagagcccctggcaagccactggtgtaggtccgagagtccaaaagctgaagaacctggaggccgacgtgcgagggcgggaagcatccagcatgggagaaagatggaggccagattcagccagtctagtctttccacgttcctctgcctgcttgtatcctggctgtgctggcagccgattaggtggtgcccacctggattgagggtgggtctgcctctcccagcccactgactcaaatgggaatctcctctggcaacaccctcacagacacacccagtgacaatactttgcatccttcaatccagtcaagctgacactcagcattcaccatcacacctgggaagcatggaacccagaaacaagtgccagggctccagtgccagtgcctgtcctgggaagatacccaagagaagacatgaccaggaccttgggggagcatgaaatggtgagggcacagtgagcttgaaggctgatgtcacctgccaggagagcggctggcagtcctgcctggtgccccccaaggggcagagctggcagagaggggcctccaatcgaaggccaggagtcgtggagctccagtgccttggtgtggctggccttcttgcccccctcccagaggaccccgccagtaacagccctgctggtggaaccttccccagtgggcatgaaagaaatgagggccccacaagccacatggactctgatgcctggagccaagaataccccttagggtggtagaaaccgcccccggggcactgtgcagtgtggctggctctccagcatcaggagtactggggattgcctgggggacgactcctagggctgggcgcccgtgggccctcccctgctgccactgcggcccacgcaagccgggcctgaagggcgcgagcggcatgggntggggagcttgagggggcgttgggctcccaccaagcgccagatccttgcgcgcctccagcgctcgcccgcgcggctggttcctttgggatgcggaggtgcgacggctcctccgcgcgcgcccgctgcaccccagcccgcccgccgcccctcccggccctccgcagcctcggcccgccctcgccgcagatataaggcggcccaggcggtggctgctccgagcccggacgccgccgcccaccagtcagccggcgtccccatggcccggtccgcgacactggcggccgccgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgtgagtccggcgtgccggggactgatggggggcggcggcaggacgtgggtngggggtgcggcggcccctcagcctttgcttgcctgccccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccnccaccgtcccactcggtgaccccaggcccctccggcgcgggatggcgccccaggtctcccctactccgctcaccccgcagttaatggcaaacgaataaataaatgaggcggcctcggagtgaggggtgctggaggactggcagccaggccacgaggggaacgggacctggaaatccccaagcctgggtatgagaaggcagccgagtgtgcggcggcagggcaaggttggcctgggccgcccagaggtcttcagacccaggggcgaagctggccacgacnccagccccgcggtgaagccgcgcctagccttggtgctccctgggggaagtgcagggccacggctggcccggttcccagtgtcctcccccagcccttcgctccccaactcgagagccaaatctgtgagggcatgggctggagcccctggctgccttcctcttgcccccatcccttctggccaggccaagtccgagggtgcaggggcaaggaggagagttgggggcctgagccctggctccagaggcccagagcatgcctccccagagctgaaggtgggagatgggtaggttctccctccgccgttgggtgtgactccggaactggcttgggctctggcctccaatgctgctacggggccaggcccacctccgggcccaggcagcagcactgcagggcctttctaccctccccaagcctggggcccaggcagcccctgtccagcaccaatctgtctatggggaactggctggtccctctgctcaggggaccccgcagtccagggttctgagtgggagcattggcaccaccccactcctgaaagcgggggcctggcaggatgaggatggcctgtgccccccacaccttggcccctggctcggagagcagggtgacaggctgccttcctgggctgtggagagcctcgcgtgcacctcgcctccagctcctgtgctgggtcgtgaggtcgacctcacaacagcagaggacaggcccatggggtgccacatgggccaggtgctgtagggcagaggccattctggagaggaatgtggggctgaaaaaagtactgatcataagcctcattttgaatgcggcgagaccaggcaatctatggcctccctagacacctcccnggaggctgcagtaagaacctcttcggcctctgggctgctccaggcgggccgtgacaggggtgtgggagacagagatcccatggcccctggaggggccaaggggcaaggagcctcagctctggctctcctccttattctagcatcgcctgctacagggggtggccccaggctttggagggctggaggcctgggtttcactcactgccaggctgcccgctgcactcccggctgctgggtgcatggtgggggcagggccaagagggtctccttgctgagtggttccctnggtccttcccagcagggctgggagccccgcgcagcactgccaccaggctttattcggttgtaccaaagagatttccgtcagccatgtacaaacagaacagagtccataaggagagtggcgaagctgccgggaaggaaggcaagcgtgttttcctggagccaggcgctgggtggcaggacaccgtgttggggggtgcccagtgggaggntggtgtggtctacacccagagaactaaaggggtgaccgcagtcactgctccctaaagccctctgctctgcacctcccgccacagctgggtgggcagtcagtgtggcctctgtccaggtggtgggggcatccggggaccaggtgggggcgcacgcnaggagcggtgcgtttcaggctgcaggtgccgtctgcccgtctcacttccggncctctccactgtgctggacaccctctctgagcagctttgctggaaagagcggagagcctgctgcaaaccaggcaccttgtaggcaggcaaggaggcagagtcctcaccagcccttccagagccaggccagttagagagggcggccctgcagagtcctatgtccaaacgcagaaggcgcagaagcagagcagggggagggccggccagggcctctgccaggttagaagtcaccatcgcngctcccccaggggctgtgccgcctgctgcctggcagcctccaggaaggccagctccttggcttccttcttctggtttcgcgcctcatactccaacctgagagggcagggtaagtctagcagagagcgcccatgaggcggctccgagggggagggcacggtaagtctagcggagagcgcccatgaggcggctccgaggtgcccccnacccaactgcaccntgttggtgatgatccgctggacgatgaggtctgtggtgaggttgctgccactgtcaatctgacggaagatgccccttctcttgggctcctgggggtccagagaggaggagcgggatgaaggtccctgctgacctccccaagacccatctgatgccctgccccagagggagaccagcgcccagggtcccatgggagtggtgcagtcggagcagctgcgccaccatgcccgtttcccaggcaggcacagtgagtcattaaatggctgggaggtgccaatggcaacccctgtgcccagcaagggccagcatgacccacctggtatgggtcggagccatccctgtcangggnataatttctgtcttgccgtgacacaccaggtccacctggagnaaggagtggggtcaggagccctccccggggaggcagcggccgtcgccacccacagcccagcacaggccccgggggnttngggagagctgaccctgccctttcctcagcccaggtacctcctgggnccccgcctaggagcccacagccagcctgcattcccagcccatgcaggaancagaggtgaacagagggaacgaggtgagcccatgcggagcctcaccttgaagtgacttaggagctctgctgtgaccgcgtacggggctccaatcaccacttctgacacgtactgtggggacagtgggggcagaaagacttgctcggtccctgctactggtaagccagggccacagggtggtgagagacggctcagacatggggcggggctgccagtgagtagcagggatgggctgggcaggctggggacccctnggggctcctccatgagacaagaaggaacagcatctggagacctgaccacccctcctcatgcctcaacaaacaggtatgggcaggtgccacagaactcggggtgctgggtgcagctctgccagtgacccaagcccccctgccctggctcagggaggcccttagtaggggggantgttgntnggngaatgtctccccatccttgggctggctcctggcccccactcacccggcaggccagcacgctcagagtccgttcatgcagattcatgatggggtagttcttccccnttgtagtgattgacctcctgcggccagagtgcggctagctcagcccggagactttttggggggacagggtgtgcccctcccggnctgtccctcatgggaagaagtcggggaggttgctcgcccttgtggggatgccccagacaggacagccctggaccccagaagcctacngatcaccccccagggtctcctgtgacttcaccntggggccccttcccagagaccacctgcacctaacagcaacgcttagggcccctcgagggcccatcagctgcccaggggcccagggagcaagaaggcagtgacctggtcaaagtgtaagcccgcgatgatgtagggcctctctgccagcctgtgcaccttctccanggaagtccacatgcccgatgtctgcacccaggttaagaagcagtcgggatggggatgacagggagcagctccctgacagctcatgcccaagggcctccccgccatcctccctgctgacagctgctcccctgcaaaccagccagcccagtctgggggccccaaggagtcaagtgaggcccccgggtcccaccccatgtggcacatgtaggggagcagcagaggcccagaggatacggaacaggtcgaaggcaccagccacatagatgactgtctcccctggctggggctccttcccagnaagcaaactggatgatcttctgagatgtctgcaggaactgggataccccggtccaggggttccgcccaccagggcactgcaagccaagagagggagcaggttggcgggggaggcctcccaggtgctgccctcaccaggtcaccaaaccctcagctgtcacctgccagcaatcccatttccagccagtcatctcgggcaggggacacactgccaggccaggtggcaggtgggactgtggcgccaccccacaaccacagcaggcaccgcagcagacaccacttcagcccagcaagcgaccaccaggaggaggcaaggagccctgtggcaggtgcacacagcccttgggagggacctggtaccctgagaccactgtctggtcacctgggagcagccttctgaggaaagtatgtccccggcgggtatcgggtgagggggctacaatgggagagagggccaggccacttggttagaggccacctgntccacaggcaaatccttgctcctccaagcagtggctgccgtgaccggccagccggtgccaccacccgcctgccctccctcccagcatccaccagtgagccaaacctggcagtcagtgcctggtcagtgccagggacagagggaggagggtgaggctctgggctggcctttccccaagggatggctgggacaggtggccgggggagccccctgcagctgcgtgctcagctctccctgcacagccgcactcaccttgccaaaactgtctgcatactcccggtactcangaggacatctcctgcacagaaggtcagagcagggctgaggggcctgccctcccggcgtggccaccccagaaccggctggggatggggagcagtgggcaggaggaccctgagagggcagggaggtgcccctcctttcccctggagacctcgacccaggggcctcggggattccgccgccgactcacctggctgctgtgatgggctttggttaccagcagcatgcggcccacgaggtctgtggtggacaccccttgcgtgcgcttgcattctctgggggacacagtgggagtggggtctcatcctgggacactcgcaaggctctgcctcctgctaccaccanctagggacactagcagccctgctgtggcagnaacccacggctgccccaaagactgagggtccccttcctgtgcaaggccataacagaaaacctgggttgggaacantggggaaggcctccancgcttttattgactgaagggagtggcaggagcacagaaaaggacccttgctggggcccaggtgtgcaatgccagggagaggatgggcactggggtagcagctctgcttcctgcctccctcacacccacgtcctgcccgctgagcatctgcagctgagtgaattctcagctgcagcatctcatgcgggagccactggcctcatgtccctgacgtctggtaattcagatatagtgccagctccccagcagtgccagccacgtcccccgagctcaacagctgccacctcacaaagctgtgcctttggagccctnggggccatgggtctgcagcaccaaatggcaagggcctccaggccaccccacaatggcacctccatccctcgagttcccagtcctgggcngtgaggaacatggcccagggcctggacgctcccctcacgggctcccggtaaatagcaaagcacgagccaggagggagccccgtgtccagctccctggatggccaggcccgcnggtggagactcacctgtacctcccagcctgctttacttcctcataggtgtcccggccatctacagtcagggtgatgtcatctaagcagtgacacacaaggacaanggatccttaacccaaagccaccagaaccttcagagcccaggaccctctcggcccctggcctgccctagtgtccgcgtgcccatttctaggtgggggcccggaaatgtctcagatcctcaaagggcggaggccccctgttcccggatgtcccaccagcagatctgatcctgagccacctgatgtccccaggcccccaggtcccagccccgccactcactgccgtgaacacagaagtcacagttgtatttgtccagggtctctagtgtagtgacgtagggagccgctggcaccacctcgtccacccatttgatggcctgcaccatcttgtatctctcctcctgagtgaacaccgggggccccttgtgcttggcgatctcctctaggaaaaggacaacggggagactggggaccccagcccacccggcccctccagtaggaggccccttcccagcacccagctgtagccacacaagagggccggtgggggcaggctgtctctctaccctggcccttagcccactagtgctggccaactgggtggctctcttccctgcgagggtctcaggcaaaggcagagattccttctgacgagcaggtgctcagcccctgaaggcttgggagcctcgctggcagtggtggggagcnaggtgccccttctctttagctgggacaggaaantgcaagatgggaaaggcattaggccatcctcagctggggctgggctgggtgagcctacagtgccctcccctacagctgtgccctggcaaggtggccccaggcctgcaggctttcagtcaacagtcgcaacccacaggagggctggggggccgcgggtgggcgaggccatctgtgcttaccatcggtgtgcacgcctacgatgaggtagtcacccatggcccgtgcctggcgcagctggttggagtggccgtaatgcaccatgtcatagctgtggagacagagagagtgggtggtccctgtgccaagggtggggaccaggtgtccctgtgggttaggggcagagctttgctcctctgaggactccttaggaagcgctctgagaagctgctgctgggagccctgggactgnggnattcggaggatgtaggtgctcagctctccacccncnactggctcctgggcctgacggntgggacccctgtgccagatctagaaagggtggcaggggcagagatgtcaaggcctggctgggtctagaggactggtgggtgcaggacagactggagcccactgaaagctgcagggccacgtgtcctatcccctcaccaaatatcaactgccctgggcagtcactttaaaataagccgatgttaactcttggggtagggttggatcctagactaccttgagacaagcaaacagtccctggggctaacccaaaacaaatccaaccacaaaataaaaccctgggaatcactggccctgaaaatcctgtctctcctcccttacnggcctcaagctcagcaggcttaacgctaagggtgaacagccactgccttgccacctggctcgagagttttcattcacaaatctaggtctgctaacacgtgaactctcaagcccaaagctacacagccctgccaccaactgggcctcgctgccctggcttcttcgccacttctttacagcagcggcccatcccctcaagtggacaaagctgtccctgcctctccagggagaggtgtgaccctggcagcccacacagtgcacagagttgctccactgcacaccactgcttcctcccagcacccctgccacagtgcgcggangcccggcagacatgctgggtaaaatctggcgggcccatgtacccactggacaggctggaggggaggagggggcagaggctgggccaggggagcacagtctggaatggggctggggcctggtcagggcaaggntcaaagtccactgacacaaagccacattccttttcccagaggtgactcggacacagaagacaaggccctgcttgctctcctgggaagggctaatcagatagaggcgcttgcnttcctggattccatccggcaggcacgtgaaagggtcagaggtagcaaattatcagtaacggtcgtcttcctttcacttgttgacaacccngaaacttttcttaaaacaatgccctctgactggccagggaagaccgatcgcattctagccccgcggaggaggacccgggagcccgcgggcttcaccgcgggtcccggacaggcaggtcgcacccgatgcccacctacagggacgctcgcccggaggccaggggaacccctggaccggagccgggcaagctggttgctggtggttacggagaagcagggaggccgtggctccagatctcagcgcggtggctgcaccggagaggtcggcgtgaccgggcggggcctccgccagaggtagacggggtcgcccacggcagggcgcggagcctctgcagcccgaccctcccggcaggcgagccccgcagcctgccagccccggcccatgccggacgaggacgccacccagaacgcgggcccggtccccgggcancggctggcgcggcgccccggaaggaanncggccccggcgcccccgcggcccgccccggccccgcgctcaccagccatcgcaccacaccctcacggcgcgcctgccccccnggcccggctgctctgcgccgnctgcagccccgcgcccgttccggatcatggccccgcancggcggcgcggacagcctggcagctcccggcgantccgagcgccgccgnccgccccgccaggngcacgctcagcggccgtcacgcgggcctcacccgctgcgcacggccaatggcgtgcgcngntcggcccgagccccgcccccnccncccncnnnccgncnccnnnnnnnnnnnnngngncncnnnnnncnnnnncngcnncnnnncgcnnnnncgnnnncggnnnnnnncnngnncncnnnnnannnncncnnnnnnnnnnnnnncncnnncnatggcgtgtgccgcgctttccgagccncgccccccgacccacacctggcctctncgcaccgcccacanntggcgctcggctggcgnggcagtgcggcgtggggaccgtcccaccgccgccacctccgggaacctccacggggcgctgtcccaaccaggggagttttttttcttattttttggcacaataatctacagttgtcccctgtccaaccaagggagttttaagccacgaccgagctgccaggcggcagacctgagcccggggagcccgcgccgaccactcggggacaccggaagccagtgcagaaacngtttaatagaaataaaaaggtctgcatagagccgaggctcggagccacccctctgccgcacatccagtacagagaggattctataaagttcacactttttcattaagtagtagtagaaatacggtgaggccctgagactggcctggtgagcgaggaaaggccgctgggcgcttccactctgcaggccggggctgaaataacccgagttccgttctcacagaaaggtgcggctgccacctcttgacacagaggccggatgggcaggtgtcctcgatggccaggccgtatcagggtacaaccgcagcagtgcaaggggcttcctcaaggacaaatggctaaaaatgtcacggtgaaaatgtcatccccaaagagttcgttctccctagacccgtgggggcaacccagccttcaccgtgacactggccatctgcaaagtgccaactgttcttcatcgagcacgtgattacgtcactttcttcctttttgtgcgttttgtgcagcccctgccaaaccagccccctaggatgggggccgagctaagcggtgcaccccggtccccaggcggggcctcctctctgcttctgcacagcgacttccgactgtggctgccttcnttncancagcacgcaggggagtcgccagtgagaaaatgggatcctgccacctgccaaaaagggaaagcggcatcaggcgggcctgggagcctctcgcagtcacacctgccccagctcgggaaagctgtctgcggtccctgccttcccatccccttccctcccgtgtcaactgcggcggggctctggttggcggcagcttcattgttaccaagctgcagaacggatgtgggagaggtcacctcttaggtggtgactcaaaggtcggcacccacactagctcggtctcctcaaaactccgtgtccttgtccaccactgagcggcgtgcacacacagggtggggcagcagtggccccagggctgcctccgtctccagggatgagtcactagcaactctgggccccaccttccacttgtaccgctggggcaggtggaccagaccctctcccccttcccagctgactagggaggcgtggcctacagacgaccccgtgaagaaagcatgtgtctgacggagatgcagaaccacagatcataacttaagatacagatacgcactgataaggaaaatgagctaagttaatgtaaaaaaaaaatacagtacacgatagcccacatcacagaacaccacacacataacatacaagaagtgccaggcccagaaggtgaagggatccttaatttcttgaaccctttgattaaaagaagttattgatttcccctataagaccctgaaaattcacagagaaagagagtgtaaactttttactcaatacatacaccaagtctaaattatcacaaattctgtattaaggcacagtttgtttaagctttcccaaagtacgccaactcccaaaaccaagcacacagattctgtctgaccagagctgccgagtgctcgtcccctccagatgcttcccaccaggcatctcggagagctccacggggaggcctggagcaggagcacgcgggcagaatccctctccccgcggggnanttgtgtgtgccacatcagccagggcaggagtggcacacgcagggntctccgccaaccaccgaggtcaggccctctggagaccaccacngcttcagtcatgcctcaggcaccactgcaaacacctcagagcttcctccacactcagnctcacgagagaagacagacaaggcccagcacacagaggtgcggggaagcaggctgctgcagcggctcactcacctgctataggcggggatctccaagcccagnctcggccatgaggagccgcatgacgtcatcacacttcccatgtagcttcagggcagcccagtcatccttcggggtccactgaggacagggaaagccgagtgagagtaacagcagcccaacccttcccggtggcctgtcagccttggcccctacgggctcagtcggtgctccctgagcacccacgggggccctatcagaccgccctggtgcatgggtgtggggtgtctctggctgtgcgttctaagacccagatctaaggacgtggctctcagcacccgagttacctgcaggttcacgatgtaaagcttcggccgccggnctagggggcttggtcatgcaccagaggcgtgggtacttctttagaancnctgtggaagcagacagacagacaccgcacacacacaagggacaagtctgtacagtgctgggccgcagagctggacaccctcgggcaggcaggngctcggttcactcattgtgtcatcggcacgtaccttcaggctggaccctagacacaggatggtgtctgctctgctggcagcctcggtcgccgcnttcccagttcaaaggctgccccaacgtccccctctccccaaagtgcacaatggtgtcccgcagctgggtcccacacttgtggcaggtccggcctgtctggtgtctgtggagggcagtgcgctccgtcacatcgaacacccgcacgtactccctgttgggaacgcaggaggtacagacctagaggcaagagggcacagtgagtgggacccgcctgcccatggagaccctgggtccctgcaggactgctcacttcaatgtacatgttcccgtggagctcggagatggccgtgcgcggcagcccactcctcaggtggagcccgtcacagttctgagacaccacatgctgcacctggaaggcagaacgggtggcaaggggagggatggctgccagtggtggtggggaggtcagtacccggccacagcgaggctgttctgagccccgccgatggctcccaaaaccaggggcagctccgtccccccagagagccttagaaagtaaaacacacaacaggtccaaccaccaggagtcaagagggcctgtggtggggagngggctgtccttcctccagccctgatgcacctggagtggctgggagggcaagaggttgcaccgtcccggcaaggttgggaagtggctcggggtttggcaagggccactctgccccagatccatgctctcttgggtcatgacatttcaggtccctggggacctaggcagatcaaccactacaccccattggttgagggtgttcagcagaaggtccccagagatgtcctataagcctcccctgtgactaggatggcttctgaggtccacagaaaaatgcaagggaatcacaaaggggaaaggccaccagcagctctgaggctgaggctggctgcggatgggatggttcagagggggagctccccttctgtcctggagagtcaagcacaggaggatcaaacccgcggcctaacccgcttggtgggtgctcatcatgggagtcaactggcagacagagggcgggtgcagttagttgcccactgggcaccaaggtgctctgcctggtcccntggcaagtgtaccagccacccagggctcttaccagcttctgctcatgcagacgggtgatgctcatgtgggtgagggnttggctcggcctcgctcaggtcggcagcactgccaggcagaaaggaaggcaaggtgaggagagctggagctcaggcccgtgctgccgctgcccagcctatgtgggaggccatgcctggcccgcttacctaacgcttctccctttctgaagcagtgtccacactccattagggccccggtagtctgggatagacgctgcctgcatgtcgagaaaaaaggtaagccaagtcaaaaggcaccactgtaggtactggcagaattcccagaaacggaaagccactgtcactcctgccgcattccgggctggcctgcatgttggcctctattcattccacagngctgacctgcctgagcccatatggagtgtaccccaattcggctcctcccttctacctggacttccgtttcccgcctggcctggctcatccttccaggctgcacgcagccctgcctgcctccggaagcctctctggcaccgagcacaaagctgggctctgtggcacatgtgtcctccacactgcaggggaagactagtcatgttcctaaagtgcccccagggccgagcccacagctcacacatttagcaaatggtgaatccctaggtgggtccaggcgactgtccattctcatgtcccagtgctgactattcccgctccaccttaacaaaggcagaacaacttcttcagatgagatgagcatctaacttcccaggttttcaatcctgtgaaacaaactgaggcccacagagggcacacaagatatgccaggatcaaggtgtcttgtgttcccttttggggactcccgactcctgcttaaactcagaaaaatgcaccacccccccnggacagtagttccgacagtcacattcaagacgggnaaccntcaancactccgatgaaatccactagctgcatgtgcttttagttgccattggaagttccnatancaggtcacgtgactgttacataattacatgactggacttttttttttttttttttttttgagagacggagtttagctctttcgcccaggctggaatgcagtggcatgatctcggctcactgcaacctccgccttccagtttcaagtgattctcctgcctcagcctctcgagtagctgggattgcaggtgcccgccaccatgcccgactaatttttgtatttttagtagagacagggtttcaccgtgttggccanggttgttcttgaactactgacctcatgatccgcccacctcggcctcccaaagtgctaggattataggcatgagccaccgcgcccagcatgactggacttttacatgtgacttgtggagggaggagactaaaccccagggctccgggtatttgagtcagtagtgaactccctttttgcattcttgctgctgagcctctgctgttctttgcttggagtgcctcattccaaccttctgtaaatctcacccatccttcaaggcccaatcaaggccacctcccacaaaaagccaacgcaggtgggtttcccaactccaagagcgcagagtgtgtgtctgagtttgctctagcgacccagcacagccagctttacagtatggttatttgttcacatgcctgatccttgtcacctaaaagcttcctgagaacagaaatcacctgggnttcagatctgctaggccgacgcgtgcccaacaccccacacacacccatcaaattagatggacgaggtgccagctacactttcaaagctagtgatngtcccacagcccaggatanacttgtncagtgaaacttctcaaaacacaatgcaattctctccttcacctggtgtattctggctcttactgtgtcactttctacttatcttccnctcgacatggacagaacangagtggaaaatcacaactttgggcttagctctgtccacataacctgggggtgcctgcgagcagtcggctactacaccccattcgtatctctactccttgttttttttaactggctgtaacacagaggccaagcgtttaaaaagcgtttaccttaggtaagttttggtcatttcgtttctnttaagagaaaaaaccttagagctgctttaaaggcgagtttttcgcgattactnggagctcatactccgtcctngggtacgcctccgcctccctccctaccgtgctgattcccgcgcctgtgtagacgaccaagtatttggcgttccggacggcgctggccagctcccggaccttcccccgcagctcctccgggtcgtcgcacacctgccaagacgccagggtggtcaccgccccgggccgccccacccgggaccgcccgtcgccccagctgctcccgaaaccgggggcgcccgcgcgccgcacgcggaactcgcctcctcctgccgccgcttcaggccctcgcgccgccggctccggccctgcagctccgttaccaggtccgcgctctcggccagcagccggccctcctcggcgctgcgctccgccgccgccttcctcaggatgcgcgacacctgcgggcaggcggacggtgagcggcggcgcgggccgggcatggccgggccggggagcggcggcggcgtacctggcggaggcgctccctctgctgctcctcccgcaacctccggacccgctccgccgctttgcgctcggagcggctcagacccccggctgccatcgctcccctggagacctgctcttccgcttccgcctcacacggcaggccgcgctcagggcgcatgcgcaagatngggccccgcccccacccaccccttccggctccgcccgccgcgtcgccccaaagaagcacctgccagtctctttaaaaggtttattgatcatatacaaaataaagaaaaccttatatatcacaaacatacactatgtacagcaataaatacccggggggccaggcccagtgctgcccctcctggacaataatttagcaataaatactgcgcagggcaggggtagggcaccaaggccactgccctgcaagaggtcaggcccctgcccgccctacacgaagtgtgagcgctcgggcctcaccccgcatccaaaccccagcccctcctcacttagatctttaataacctccatcccaccccagcagatcccggggtcttctcccacacacacaacctcccctggctagacctaggcagggcaggcagggactgatcaactctgcttggacccacctctcagcgccaggagagcaacagggctggacacgcgggcagcccttgtcctgttgccaggagaaggctttctgtgcccactcccngtttggttaaaggcttcagggactagcagattgagggggtgggaagaagggcagggctgggacacaaggttgctggaggggccaaagcccnaactggggtcaccaagaacagggaggtctcacagtttatcggggacacactctagctcagactcaagggacacccatggtatcaaagctgctgctccaggggcagggtggaaatgtgtgggactggcccagcaggtatggtacacacccaggacacaggccagaggcaggacaggcattagtctctcagacacgccctgcctctgtgtggcactgattatgtactctactctcccgacctgctccaaggccagacagccaacaggaaggcaaaaatacaccaaaaagaattattcagtggcttctgggggaaaaatcgttaatgtgttggttcctttcaccaaaccacagcctaaaaaagtaactcacaagatcccagagcggaaacggtgcagcaggctgcggctccgactttccagatgtggatgggcgctttggccaagtggccactccagagggaggcagcagggacaacatgggacctgaccatcgtcccaaagcaggctgcagccgctcagggccgtgggccgggncccntgatcaccagtcagaagtgtacacacatatctgaaacatgcaccaagagctgagccnagcaacaccagtgccaccccgagcagcagccaggggcctcactctcctggtgagagctgacctgtccctgctgggtattcctctgaaatctgagcgtccatgttaggataaaagaggagttggggcaaagttnaaggtggaagggaagacatatatcatggtttacttggcggacaagtttgagagacctggccttggccaaagccctcgattcgctgtgtcagaaaaactgaggtgagaagagaccaccaccctnctccaccaccctctcagntaggaaagcgggatcaacagagatcagaaggacagcacactcacacctgcacatgaacacaccatctatgtcaggaaatccaggggaaggggaaganggggtggagtggctccgcagggctgacctgacaggggacaggaacactcccctagacccagggaagtcgccccaaatccaaagctcttgaaaggaggtatggcctcgaaactccagaagcctcttctgccaacgcaccgaggacctgcacctcccattcagcacgcgtcgacccttacaccctcctcttccacactcccttcgcctccaggtctgcagcctggcagaggtgctcaaaatggatggccacccacagccaggacaaaagtgggggctgcacaanggacaaggagggcctgtttctccccactccgaggcagatcatgacgttttcttcatggatacttatgatatgattccaactaacgcctggattctacttagacaagatcagactgaggggagggggatgaagtcactaaatgacanagagtcaacagccaatatttccattttcaggctgacgcaggtagacacaggacttgtctctgaacacctcgagcaaagaaaagctcattaacatgacaagtgttgatggtgcctccctgttcccatcctgtgggcacaccaggccaaactattggataaaaatcccaccatccatagggttaagccctgttgggccacagtttttcatcttacccacatctgtgtgctttacagaagtctgggccccacagaaaagaaaccagcaacccggtgaaaggccagggctcacatggccagacacagggctgtagcctcttggaggtgggtaggggcaccccctccnccatcatatgcctacaaggagcctcctgagcccagccaggaagggcagcagcctctggcgaggaactgagagcaggaggcaggctgcgcccccacagggaggcacctccagcagaagccaagcagctgatccnctggaagacacagatcccaaagggaggcagaaggcaggcccgaagccaagagctgccagcgtggaccagcggagaagagggacaagacccggnccctgngagactgntagcccnttgtctgcactggtggagacccccaaggctctcagagtgaggcagggacaaggaagaaagggcggtgcccggtgggcccccacccactctgcctggaagcaccacccgcagcatggaaacacctcagggatcaagcgggcggcgagacctgcagcccacggcgcgggcagcctataggaacaaagctgaggccagaggaagacggccagggaacgcttggccatagccctgtggccacccacagtgactccctcatccctgtaatgccaccacccaaggccagaggtggtgggtgtggaagcagcgtggggcgccccaagggaccccagtttcacctaccccgccactagatcagcccaagccctagacacagatgtagccaaggctcagtggaggggggcatgacagaaccccnatgtctcacctcctacggaccaggagctggtggtgggcacagattccttgagctctgacgcagcaggcgccacttggcaccccagcccaggtccagcaagccagcagaagcaaaagcacaactaaacccaaaaaacgaacacgnggaaaacagacacaagaagtgacacccacaggtcaaaggtcaccagaagcaccagcactttaccgctgcacaaaacctcaccaggcacggacgacaccacggcaccggcaagagacggaagcaggaagggcagagngagtaagtcacntttcggtacaattgcaaaagatatcaaagaggacggccttctggtcggctcacggcttggcttttttttttttgtcttttttttaaactaagttttataaataatgtctgataactctgtgtatataaaaactaaactccaacagccacaaagaggtgtccgtaagtttacaagaaagggattttttttctttttttttcttttttttttaactagcaaagtttctattatactttcttcccttttccattcatatggtcaaatggtcttcttgcttgttttttttctaaaagacagttttataaatactctgcagctcttttttctttaacttttaaacatataattaatttaataactttgtaaaaggaacttctctcttttaaataaagggctatataaccacacaaataggtcatgtaaacagtgacacgggacccatcgcagggcacactggacccaccctcacgttaagcgcacaaccagnagatttggtcttgttcagtgcaacgggtcaggcctgagtgcacagcccctgggcccagctgcacgcccccagcaccactgcgcccaggctggtggtccacccatcagggccttcaagcccgccctactctcagagcagagcccatctcttcatgctgggctaagctgagctgctcccctggggctaaagagagtgaatccttcccagcccgcgagcctgtggccnactcgggagtggagggaacactgggaccctcactgctcggggacacgcgaggcccagcgtgcctgctccttctctctcccgcaactctctctagtccgttcccacagcaccaactctggactccaagcctgcatggccctggtacaaaaggggttggggcgaccccacgtcaccgccgaactgaccaatcccaacatacaaaacacacgacgacnatgacgagatcaaaggggctcagcccggcgcccctggggtacaggttgtgctttgcagggaangagagaagggtggggaagagagggaggaaagagaagagaaggaaacagagggacagggcagccaaattcgccatgtgcctagtggccccgcaaagacccgcctgggcagacgcgcgtccctacgatcgggcatccgtcttggactttactattgtgatgacgctggtggcggccaccttgcctgggacgaggggccccaggccggcggcaagggggccccgggctggcgccacggggctgcgggccaccgtccgggcgaaggtctgcagcgcctcgtacttggagcgcagcgcgtcgagctccagcttcatgctggcgttctctgaggccagcttctccacctcctgctgcagctccgccttctgcttctccagctcctccttctgcgtcacccgcttcacgcggcagctggcagcgtagccgcggttcttgagcgtgcgccggcgctgncttcagctggacgatctcctccttggacaggccccgcaggtgctggttcagctcccgcaccgacatggtcaccagctcctcatccgtcaggctggtgccattctcacccggctcccgcttcacctggggcacagtgcaggtggtcacaggccaagcgggcacgcccactgtgccccccgaccccagcccacaggctcctgtccctgcccactcaccttcaaggccttgtttcctttattgggggtcgtcataacccgggggcacagcgagcaggcgctctctgcaagacacggagcaggtcagtaccctggagaccaccctnngcnngcannccccccccccccngcccccggnncagttcacaagagcccttgccgcacagcccgccccagcctgctgtccaggtgcccagcccccaatacctgataggaggcagcccttggcctctcccnaggctgggctgagctgcttcnctgtccaccctgcccctagagaaccaggtgggaggtcaggaaggtctgacgggagaaggggaactgaaggctgttaggaaggcaggcgcaagacaaggggcaggggagagattagaaggaataagacgcgggagaggcaggcctagaaggaagccgggagctttaaaaataaccccggcactgcccagagcgcggctgttcctggcgagtcacgctgactcagcacattgcctctgcctccccgccgcgcccgcactccctggcccgccagccaacagcgccccacgagagccgcagcccccagcctggccaatagcaggtgagggccagccagtgaccctgtgtgtgcatcttccagnggtcctaccttctacagccacctcccctgagccggcctcggacaaagccccctgctccctgggtgcacaggggccccacgggggacctggccagagaggaggctacagggaaccccgagtctcccagcctcctaactttgaaaagcntgggggtgggccgtccatctagctctggtctgttggcaggactgaccagggagttcccccaccttccaggtggcaggccatcagctgggaggagcctggcccgaggcccctctagacctcccagtcggcctcctccactgatggagtaaccatcctgtggctttgggttgcaggnaagcagcccctgccccaccccatccagggtatttcacaagggnctcccacagtgagccaccccgggcctgcccaacgtgaaggctggcggagtcagcccctccgagctgcagcctgctctctggtccctgccnccgggtgagtgcccacagggccagggagcaaaaacaaaagtgctggggtggccggacttaacaaccaactcttccccactcggggtccctccagcactctgctctcactttcttgnctaaggatgtttctgggattcccagctcagcccagctcccaccagacccttgggcatggacccccgcctcatgctccatcccccactttccaggtttgatgcagacagatgggagactcctccagaggagctaggatcacttcaggaaattatgggctggggggcttcttactctcatcaggggagctgaagtgtggccaggcggatgcacacatcctcaccaggctcaagactccacctcacccnagcctgggaccaggaggtgaggctgcaagcacagagcagggaggggaggccagagacccctccccacagccanagccagctcagaggcaaggtcccgaggctccagccactggattcttccagataaaggatggggaangacctgagctggaggtcagaaggcccacaggagccctttcctacacgtccggcacaacactgccccaggagacaggccctcagccaagcatggaggggccccccagnccttgagtgcaagtcagggtgcagagacactgccctggcaccangcttctncccacccccnatcgcccccacccctgctgctaagcacaatgacagtggtgacttcctgaagagatcacacggaaaagtgcctcctcgacagattttgccctccgcagaaggcctgaactcagcacanagtgcaagnccatcgncctccntatcaaanggtgncgnccnggggggtgggggnnaggggcagnccctgagcacagccagtgcgttccaggctcctggcctggcctctggacctgggcntgagagggaccatgcagggatcccaggagctggactgaggagaagctgcccccgccctcctccagccctcaaggctgggcagagctggggcctgtcatgcaccctctgctcccagaggctaataagcccacctcacgcaggaggcacagatggtcacggctccgcaacctgcgagggtacctaggccacccattcacactgagagccaggaaagggagggagatttgggagctccgtctcctttggctaaagtagaaactcccgtgcctgaacacagacagccccacctggctgcaaagcccagcggccgaaactccccggcagtcatggcctctgctccataagctctcagctcctganaagtcactctttgaacagaacctaaaacttagtttccactgatgcataagtganctgagaagatgtacataaatgggccgcgcggtggctcacacctgtaatcccaacanctttggganggccgagngtgggtgngattacgaggtcaggagatcgagaccatcctggctaacacggtngaaaccccgntctctactaaaaatacaaaaaaatagccgggcgtcgtggtgggcgcctgtagtcccagctactcgggaggctgaggcaggagaacggcgtgaacctgggaggcagagcttgcagtgagctgagatcgcgccactgcactccagcctgggcaaaagagtgagactccgtctcaaaaaaaaaaaaaaaaaaagatgtacataaatgtccctccaggaccccaaaanttttcccagggcatcaaactccaggccaacggtcagctaaaacattgaaacatctggaatctataagccccggggctcactgagagtggancctgtgttctgtgtgtatgtgtggggggtgctcactgagaatggacctgtgtgtgtgtgtgtgtgtgtgtgtgtgtgtggcggggggcggggggcatccctgagggcaaaccacaaagtagcctaacccagccatgaaatgaactcctgggcaaaggnaagtcaaccttcgtgaatctccacatacccaaggaaaggtggctctggccacatcactcccaagctgccactttctaagcgtcctgggctgccaggccagacacccaacagggccactccctttgctaacttcacacaacgctgagaccccacttcaggtagcgacaactttagggtggctgggtgctgcgttctgccaccctgtgccatccacaccagcccatctgctgcaccccaaggctaggcaccctgaagctcccaccacctacagtctcaacccagactccagggccaactggggagagaggctgggctgcttcctcccctttgccgtttcctggtagagctgcccctgcttcctccctgcccagcccactgtcacccagggcttggtacacacacccctctttctcccaggacctcgatctctggccaggggctgtccaaccaggccagtcccagggaaagccgacttcccctttggctagctcggcccaccgaagctcctcccctccctcactcagggaactatttcccagtttggaaaactgctccagacttgggaccaggaccagctgccggaaaagagccgcctgggaaggggtggaccgcccggggcttcacctttgaccccgggagaacacctgcagcgagccacccccacttcctcttcaagcacccctgccnttcaactggatcgctcggcgctcacttaaacaggcaccccaaggcgccgggcctggccccctcccacatccccacggctccctcccacctcccgctggcggccttttagtccccgaggcccctcgctcgaatcccctccggtatcagcttgagcaccgagtgacctcacgctgatgactcagcaagtctccctccgggctctggcacgcgactgacggaacccgagccccagccaggggcagggtcttccnccgcagcacccccatcgccgcccctcctcccgggctcgccgcggacccccgcgccggggagagctgacgcggccaccggatgaatcagcagctgcgggccgggccgccgggccctggcgcggacccccgggcgcctcgctcgaccccaccctttcctcccngccgtccagtgcccctccctccaggacgcccgggtctccgagtccgctccgcactcgcccggctccgcgggtccgccgccgcccgcggcccacctccagtacccgggcgccaggggcaggaggagctggctcctgaccgctggggaaatcgaggcacgggccgccagcanggtgcgcggcagacccgaaaccagcggcccccgccgccgggcccccaaccgcccgcctagctccgggaggagccctgcctgcgcgccccctcggnnccnnnnnnnnnnnnngnnnnncnnnnnnnnnnnngnncnnnnnnncnnnncnnnnnnnnnnnnnnnncnnnnnnngnnnnncnnnnnnnnnnnnnnnnnngncnnngnnnnnncnnngnccnnncnngnnnngnannnngcnnnnnnngnnnngncnnnnnncnngnnnnnctnnnnnnnngcnnggnnnnngcngannnnncnnnnannncnnnnnnnnncnnnnntngnnntncnnnnnnnnnnnngnnncnnnnnannnntcnnnngnnnnnngnnnnnnngnnnnncnntnnnnnnnnnnnnnnnnnnnnnnnnnnnnnnnnnnnnannnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcccaccagaggccataaacagatagttcagagctatgagaacccaggtggctaaaaacatgaaaaacatggtctcaccagtaatccaagaaatacaaaacaaaacagtacggccctggcatttgcgaaacaggccctgaacctgcgaggtgtggccaccgagaccgacaggcaccacagcctgggggggcgtcggccagcgtgctccaggaagttcacaccttcgacctgtgtgttccaccctggacgagccatcccagagacaagggagtggacaaaactcagcgcccaaacacgttctcacagcattgttcataatcagggaagttagggcacatttaaatagtcaacatcagagcagtggttaagcaaatcccccagtgcctctcagaatcatataattgttgaaagaatgaatggcggactgtgatgtagcacgtaagtcacatggaggagggggtctgaagatcacggggatgcctgtggccatatcgaaggaagagcatgatgggaaaatccatcagcggctctcaaggacagagcaggggagagtgacttccaggaggggaagaagattccagatgctgatggggtgctggtgagcagtgcacacgcttgtcaaaactcatcaaactgcactaaaggtctgtgctttgtattgtgtataaattatgttctcataaagttgattaaaatctattatgtaaaattatatatagactttccctccatcttaaaatatataggaaaaagacaaaggaaataggttaaaatatcactaatggttcatttggaataatgagatttggagagttggacaatttcttcttcttactttgttttccgtggtaggtttgctcagtggtggcccccgcaaaagaaacgtttgcctcctagcctctgaatttgaatgtcaccatatttgggaaaagggtctttgcagatgtaatcttaataagagatcttaatatgagatcatctgagattacttggtttttagtaagtaacctttaatttttagaacaattttaggttcacagcaaaattggatagaagttacacaggtttctcatatcacacccccacacaggcatacaacctccccttatcaatatttcccatcagagggtacatttgctacagtgaatgaacctacagcgacacagcatcgtgacccaactccgtggtttacatcaggatttactcttggtgttgtccattctaagcgtggacaaatttatcatgacgtgtagccaccgtggtagtgtcacagaacagcctcactgccctgaaaccctctgcgcttcccaggtcacccctccctcccccagctcctggcaaccactgattttatacggtctcagttttgccttttgcaggatgtcatatagttgggatcatacagcacgtagccctttcagattggcttcttagtaatacatttgagtttctttcatggcttgacatctcatttcttttcagcgctgaataacactccactgtctggatgtgccactcacctactgaaggacctctttgttgttcccaagctttggcaattttgagtaaagctcctataaacgtctgtgtgcaggcttctctgtgtacatactttttcggttcatttacctaaataccaaagacagcgattgctggattctatggggagggtatgttccattttggaagagacggccagactgtcttcaatggtgctgcactgtcttgcgttcccagcagccgtgaacgagagctcctgttgctacacatcctggccagcattttgtgttctcaaaacacattctggccactctaatagatgtagagtggtatcattgttttaatttgcaatctctagtggcgtatgacgttgaacatcttttcataggcttacttgccatctatatatcttctttgatgaggtgtctgttttggtctcttgcccattttaaaatcaagttgttcatttttttattgttgagttttgattgttcttcatgtattttggatatcagttctttatcagatgtgtctgtggcttgccttctcattttcttgaaagtgtctttcacagagcagaaatttctaatttcaaagaagcccagcttatcaatcatttcttccatggatcgtgcctttaatgttgtatctaaaaagtcatcaccttacccaaggtcatctaggctttccctgtgttaacttctaagagttttatagttcgcattttacgttaggtctatgatccattttcagttagttttgtgatgggtgtaaagtctgtgtctggatttaatttctgcatgcagatgtccagttgctctatagcctcatttgttgaaaagacaatttttggccacagtatcgtctttgctcccttgccaaagatcagttgacaaaattatgtgagtctatttcaggactttatcctattctgttgctttatttgcctattctcatgtcagtatcttgattatggtgtcttttgcctctctctataaaccttagaatcagtttgtcaatgtctataaattaacttgctgggatttttattgagagtatgttcaatctacagattaatctagaacaactgactcgacaatatgtgagagggtctccaaaaggttcatggaaaatgcatattatgaaaaaatgcgtagatttcaatttcaaaataaactcatactaccttgttataacacatctgaacaggctctagtttgaggcactaagaagaataggacagcagtttcaaaagagcccctatcagggcaacatgaattctgccaactgaatctttgagtttctcaccattaagtaggatgtttgttttagttttttggtagatactctttaacaagttgaaaaaattctcctgtattcctagtttgctgagagtttttaatcacgaataagtgttaggttttgtcaaatgcatttttgcatccatggatatgatgatgagatttttcttctttagcctattgatgtgactaattttcaaatgttgaaccagccttgcatacctggaataaaccctacttttcataatatataattatttttacatattgttgaatttaatttgctaatattttgttgaggatttttacatgtatgctcgagagacatttgtctgtagtaatatctttgtctggttttggtattagggtaatgctggcctcatataatgagttagaaagtattcctgctgtttctacattctgggagatattgtagaggactggcataattttttccttaaatgtttggtagaattcaccaatgaacccatctgggcttggtgctttctgttttggaaggttattaattattgattcaatttctttaatataaacaggcctattcagattatttgtttcttcttgtgtgaattttggcagattgtgtctttcaaggaactgctccattttatctaggttatcaaattggtgggcatagcatttttcaaaatattcctttattattcctttaatgttcatgggatctgtagtgatgtccccctttcatttctgatattagtaatttgtctctctctctttttttcttagcctggcagaggcttaccaattttactcatcttttaaaagaaccagcatttgtttttgttaatattctctataattcctggtttcaattttattgatttctgctctaattttattatttcttttattatggttagtttggatttaacttgctcttctttttctagtttcataaggtggaagcttagacgactgatgttagatcttcttttctaatatttgcattcaatgctgtaaatttctaagcactgctttaactgtttcccataaattttgataagttgtatttttatttttatgtaattaaaaaaactttttagaaacagggtcttgctctgtcacccaggctggagtgcaatggcatgatcatggctcactgcagcttcacactcttgggctcaagtcatcctcttgcctcagtctcctgagcagctggtactacaggcacatacaactgtgcccagttaatttttacatgtttttgtagagatgggggtcttgctgtgttgcccaggctgatctcaaactcctggcctcaaatgatcctcatgcttcagcctcctaaactgctaattcaaaatattttaaaatttatcttgagatttctttttttttttgagacagagtctcactctatcgcccaggctggagtgcagtggcacaatctcagctcactgcaaactccgcctcccaggttcacaccattctcctgcctcaacctcctgagtagctggggctacaggcgcccaccaccgcacctggctaattttttgtatttttagtagagacaggatttcaccgtgttagccaggatggtctcgatctcctgacctcatgatccgcccgcctcggcctcccaaagtgctgggattacaggcgtgagccatcatgcccagctgaaatttcttctttaacccatgtactttttaaagtgttttgtttaatcttcaagtatttgggaattttccagctatctttctgttattgattttgagtttaatctgttgtggttggaaagcaaacgttgtgtgatttctgatttataaatctgttaaaatgtgtttcctggcccagaatgtggtctctcttggtaaatattcaatgcaagcttgagaagaattctcaatctgctgttgttgggtgtagtatttagatgtcaattatgtccagttgattgatggtgttgttgagttcatctgtgtccttattgattttctacctgctggatctgttcatttctgatagagggctgtggaagtctccagctctaatactggattcatctatttctcattgcagtgctgtgatgtttttacctcgtatatatttggcactctgttgttaggcacatacacattaaggattgttacatcttcttggagtgctgatcctttatcacctgtaatacttccctttgtctctgatagctttctttgctctgaagtctgctctgtctgaaattaatatagccactcccactttctttgattagtgttagcatggtatatctttctccatccatttacagcagatcttcaaataacatcattttgttcaacatcattttattttgttataatgataataagttttgtgcattctccccatgtctgtgtgggttttctctaggtattccagttcttcccacaccccaaagatgtgcacactaggagagctggtgtgtctccatggtctcactgtgagtgtgggtgtgtgtgaaatgtgccctgcaatggaaaagagtcctgtccaggattggttcccaccttgcaccctaagctgccgggataggctccagccacctgcaaccctgagctggagtaagtggattgaaaaataaatgaattattagtaaagtattttaaaataacaattcataaactatatgacaatcataaaaatacatgaccacaaataatgtggtacaaaagtgctcatcaagcctgccatgtttgctactgtttgtttttgaattgagtggtggtaggaggtgctcctcagaattttcagtttacaagcatttattccttgatttaacccaccaccactatgaccactgtcattgatgattcctcaaaattgagtaaataattatcttacttgttttaatctttcttaaatgtatgtatatcttacatttatttcaatgtttaatattataagtattttgagcctatatttagaagtttggtgatattgttgtgaccagaaatatgtcacaaaaaacttaactcttgtgtttatcaattagcctataggaaaagtggttttgttatacatcactttactcaaaaagccacagtttccaagaacctaccactgacgtttagtgaagacttactatacttttaatctatccgtgtccttctatgaaagtgggtttcttgtagatgacatatagttgggtattgttttctatctactctgacaatctgtcttttgattgatgtatttacaccattgacatttcagggattattaacataattgggttaatagctgctatattgtttactgctttctatttgttgcccttgatctttgtttctaattttgtcacacgttttctaccttttatggttttagttgaacattttgtattctttcattttctctccattctgagcatatcaactgtacttctttaaaaatttttttgtgtggtttcccttgagtttgcaatatacattatacaataatctgtaagtctactttcaaataacactatacagtttcatgggtggtgcaaatatcttataataacaaaatatttctaattcttaaccctttcttcctgtatcatgactgtcattcacttcatttatatgtgagcatatagatgcacacataattcagttcattgtcgctattattttgcactgttttctgtttgctaaattaaaaaaaagacaaagtttttattttacttcatttattcatgttccagtgctctcccttactttatgtagcttcaagtttctgacctacattattttccttctccttaaataatttcttctaatatttgttgtaaggaagtctattggcaaaaaattccctcaatttttatttgtttgagactttatttttccttcacttttaaaggataatttcgcagggtactgaattctagtttggtgtttttttctctcagcactttaaatatttcactccactctcttcttgcttatacagcctgcctgcctgcctgcctgcctgcctgcctgcctgcctgccttccttccttccttccttccttccttccttccttccttccttccttccttccttccctccctccctccctccctccctccctctctccctctctctctctctcttttctttttctttctttttgaaagcctgttgcacaggctggagtgcagtggtgcacccacagctcatcacagcctagacctccctgggctcaagtgatcctcccacctcagcctcccaagtagctgggactacaagtgctcaccaccacacctggctaatttttgtgttttttgtagagatagagtcctgtcatgttaccctggctgatattgaactcctgggcttaagcatcccacttgcctcagcttcccaaagtgttgggattgtaggcatgagtcaccatgcccagctgcttacacaatttctgaggagaagtcagatgtgattcttatccgtgctcctccacaggtaaggtgattgtttccctctgtctttttttcaagactttatctttgactctaaagtttgaatgtggtacacctaggtggtgtttttggttgtttggagtttttttttttggcatttattctgcttaatcttctcaaagctttctggatttatggtttggtgtctgacattaatttggaaaaattcttggtcattattgcttcaaatttctttcttctccttcttgtattcccatcacacatatgctacaccttttgtagttgtcccagagttattgaatattctgttttttttttttcctttttctccttgcttttcggtttgggaagtttctattgtcatatccttaagctaagaatcatttccacagccatgtatgtctagtcagctaacgaacccatcaaaggcatccttcatatctgttctagtggttttgatctctagcatttcttctttattctttctcagaattttccacatctctgcttacattacccatctgttcttgtcattcctgatctgataatttcaacattcctgccatatctgactctggttctgatgctattccgtcttttcaagctatgtcttttgtcttttagtatgccttgtaattttttgttgaaaggcagacataatgtactgggcaaaagaaactgcagtaaatggccctttagaaatgtagtgatccaagctgggtgtggtggctcacgcctgtaatcccagcactttgggaggcccaggtgggtggatcatgaggtcaagagatcgagaccatcctggctaacatggtgaaaccccgtctctactaaaaatacaaaaaattagccgggcgcggtggcaggcgcctgtagtcccagataattgggaggctgaggtaggagaatggcgtgaacccgggaggcggagcctgcagtgagccgagattgcgccactgcactctccagcctgggtgacagagcgagactccgtctaaaaaaaaaaaaaagaaatgtgttggtccaacatggggccaggagaggcattctctagttctctgaacaggtctcagccttttgaacctgtgtcctggactgtgaacttcactaatgcttttcagtttctatcccccttaaaggttggacaggatgactagaagggcctggggttcggtatttcccttctcccaggtggtctgggctctgataaaacctcaacaggcaaggctgattgaatagtttctgttgggggcagccttgttaagaacagaaggctctggcagactttaaaatgactcctttccccctcccccggctgagagcatgaggggatttctctctgatattcactgtgaggacctggtagggctcctggagataaaatccacaaaggcgtgtttcccataactgggtcccctcgagtttttaactctcaaagttgtccacactgaaccgcaattcatcaacttcatccaggttttcttatgccggcactggttccagtggaggtttctgctcttgggaagctgtgattctctgtatctgtcagtgtttctcttcaatttgccggggggcagcagtttgtcctgtgacctaatttctctgaaagatttaagaagagttgatttttcaatttttttcagctgtttacttgttaggacagagtgacaacttctaagttctacatgtatttttaattttgtgcattagatttttgatttctaaaaatcttaattggctgtttaacaaatctatctgtcattttcatagttttctgttacttgcaggtattttcaagttgatcttttacttctttaaacataatgataactaaaaataatatgtgtctgataattccattttttaagtctttgtggatttttgcttactattttttctgccagttctaactcatggtgccttgtgtctttgtatatgtagttatttttcactgtgagctgctcatgttgcttatacaattattgggggaaattctttgagtttgagatgaatgtgcatcccttcacagactgtatttgcttttcccaagctcctgtagccccatcaatctgaaatctttttaaactaattccacagcctaaagatttttggactcccaaggaacagagtctctgtgcttggaggcggcccgggcagcctggcttgtccagatggagctcacggccggggcctcgcctgtgactcggtgtgggcggggcctcgcctgtgactcggtgtggcccggggcctcgcctgggactcggtgtgggccggggcctcgcctgggacttggtgtgggcagtggccaggatgtgaccatggtgagaccaggccttgccagagcgtggacttggcagacacggctcctcccttgtgtgcggtgggagcttttggtgcgttccttacgttggagccggcatggagaagcagggcggtccctggggaccagctcctcatttgcacccctctttttaattaagtacattgtttatttttggtacctacttgtagcctagtttagggcccaccgcatattctaaagtgatgcacccaatggtgtccagagacagactagcctggagttggatggggggccagtctggggatgcaaaggtctagagaagcccaggccaagggcaggcagagcagggtgggagtgggagcaggaggggatgctgggggcagtggcagcacatgtgtcccaaaccactgcctcctaggtggggtgggacgggccccaacacaccacctggctgtgccccgtgtgggggtcaggggtgcagcgaggagggctgggtgagcagtggggtcagcagtgcggcgaggagggctgggtgagcagtggggtcagcagtgtggcgaggagggctgggtgagcagtggggtgaggggtgcggcgaggagggctgggtgagcagtggggtgaggggtgcggcgaggagggctgggtgagcagtggggtcgggtgcggcgaggagggctgggtcagcagtggggtcagcagtgtggtgaggagggctgggtgagcagtggggtcagcagtgcggcgaggagggctgggtgagcagtggggtcagcagtgtggcgaggagggctgggtgagcagtggggtcagcagtgtggcgaggagggctgggtgagcagtggggtcgggtgcggcgaggagggctgggtcagcagtggggtcagcagtgcggcgaggagggctgggtgagcagtggggtgaggggtgcggcgaggagggctgggtcagcagtggggtgaggggtgcggcgaggagggctgggtgagcagtggggtcgggtgcggcgaggagggctgggtgagcactggggtgaggggtgcggcgaggagggctgggtgagcagtggggtcagcagtgcggcgaggagggctgggtgagcagtggggtgaggggtgcggcgaggagggctgggtgagcagtgtggtcagcagtgtggcgaggagggctgggtgagcagtggggtgaggggtgcggcgaggagggctgggtgagcagtggggtcgggtgcggcgaggagggctgggtgagcagtggggtcagcagtgcggcgaggagggctgggtgagcagtggggtgaggggtgcggcgaggagggctgggtcagcagtggggtgaggggtgcggcgaggagggctgggtcagcagtggggtcagcagtgcggcgaggagggctgggtcagcagtggggtcaggggtgcggcgaggagggctgggtcagcagtggggtcagcagtgtggcgaggagggctgggtgagcagtggggtgaggggtgtggtgaggagggctgggtcagcagtggggtgaggggtgcggcgaggagggctgggtgagcagtggggtcggggtgcggcgaggagggctgggtcagcagtggggtcagcagtgtggtgaggagggctgggcgagcagtggggtcgggtgcggcgaggagggctgggtcagcagtggggtcggggtgcagcgaggagggctgggtgagcagtgttggcctcttccccgctctgcccagtacctagagtgctgccacgtctggtgaaggactcagtaaatacttggtgaaggatcagatgaagaaggaaaagttgtcagtgctgaggcaggagaagccaacctcagcatctgagcctgagtggtggtggggcagggtcctgcccagagaaaggtgatccccttcccgaggggagggctggcacggtgctcaggagcaagggctgcaggcccacaggacctttgttcatctgacctgtgtccccatgccaggctctgtcccaagcgggctgaggcagatggcctaggcagccgtcggtgaaccctccctggctccagagcctgtgcaggccccgtgggggtcaggctgctgtggggggcttgaggaccctcacttttggcccctggaggccccgacgaggcggcccttgaggttcaactggacagtattcccctgacccctgagcagagtgtggcatcaagaccccgacagtgaggccagtcccaggccgggattcggtgccctcctttaacgtgtgtgcgagtgcccacaggcctcactcagcctagaggaaggtgggcttgcgagctggggcctgtctcatgctttgcctccgtggcattggctgcgcctcactcctgcactgtggcttccatgtgttgaaaggcgagttccataggtgagaacagctccctcccagcacaccaccggcctttgctcgtgtacagtatttacccaatgccggtgaacacgagcagcctccatattcttgcaccaaggctggagaaggacccagcctgcaacacagctcatgaggcatcaggggccaagcacctaccgtcttgatgactgggggatggtgcccaggtctgtctgcccccactgtccagtggatggtgtgggaaggcattgcaggctggctgagcaggttacataacagtgcacacatgggtttactttacttgaaaccctaaaccctctgcaaacagccccctccctaatccctccctgttgactctgtagatgagcccagggtgctgaaagatgcagctgcatgcctctgcagccaggcccagggcctgcaacatccttcagccaaacgtgggtccctggggagcctctgtggcctcgccggtttcgatgaaggccagaggactggctgcacgggttgcctcagctctgcctgcctctctgttcgtgcctctctcctacctggcgggggtgtctctgttggcctcagagatgtcgctggtgctcaccctggtcacactgaccactgggcatcctcccaccccctgggccacttctgtctctgcacttggcttccctgcccacggcgtgccacccaaacaaagcccacagagaggctggcgccctcctcagccagatgcctgcatttaatagaagatgcagagacacaatctaagccaaaggaatgaatctctagtggtgaaatagcatctggtaagaggagagatttctgaaaggaggcccctttctccttctcgcccctccttgctctggaggctgagtccagctgttcctcccatgcccctgcccggagggcaacgtgcaccagggcctgagagcacagacaggtctaggtgggatccgtgtcagcaccgcagggcacacgaacgactcggcaggctccagagtttggctcattttctgcttggtccctttttgatgcctgtgatttatttataacaatagtttgcataattccaaatgtggtgacacagcctgcagacgctgagtgaaatgaagacagaacagatttttcagaggggtagtggtgtggagcaggctgggccgcgagtgatagaactgagccccaggttgtgctcggagtctcctggtgccagaacactgggcttccgtgggacctgaggggctgaaacggtgctggacctggacccttcctcacagtcaccctcaggtagcccatctcagacaggaggggaccccttgtcccccatccccatgtttggagcgtgctgagctgcacacagtcctccctgggtctgagaccgctggtcctgcccccaccccagctctctcccctctgggtcttgggtttcagctgtgatgtcatcctgcttgcctggagtccagaggggttagctggggggctcttgtttgcccagaattccttgtggctgtccagtctcagtgcccactgtgatgcctgaccctccgtgagagccagcactcaggtcagagatcgtaacctcccgagtgctgagtgtctccggcgccgcccaagctcagggcatgtttgtgtctcagttcagggcatgtttatgaattgacaaatgaagttttggaagaggacaagttcacatacacttgaccaccgagagatagagggagggtttcacatagctctctaccatgggggggagcggttttcccctggggcctagtgtgtggccctgtccaagctcacccagcctccccttgagggagcaccatagattccggatgctcagaccatgttggaagctcaggcctttggaacacctcagatcctactccagcctttctagaagctggggtttaatatatcttagcagatgggaatgtcctgtcactcagagaaaaggctgggcaaggtctctctggggatgaaaccacttagcgctcttcttttgggggatttaagcgcaaatgattcagaaacagtcaggcttcatttcttgacacggggctggaggaggtgagaagggcgttgaccaaatgaaatttgggtttggtccaagtcagaaatgtgtgagatgaatggggacaggtttcccgagcccatttaggtctgtgcacggttaccaacagcagcagcggaggccggggcaccagggtggggctcctgaatgggacatgaagaagggttaccccttctgccataagcaacaggcagggcagattttacaaacgcgttttctagcattgtttctttcagcccaaaagagttctgtgagttcatcttcagaaatcaagtttctgagaggtggggacatccaaggacactggagattgggatgtccgggaaaacggggtcttcaggcccgatctctgcccaccttccatgccctttccccagcctgcccctccagggtgcagcctccccatgccgacgaggttccctggcacaagcaggctggtgtgcatgtctgtgctttggctgcaggagctgcagagagggtgatgtcaggtccatgttgtgtagagagaattccgacatcgcccagcaggtgctcgggtgccgtgtccagcagcttggtgggcttcctcagcccctcagacccccaaaaccattttctttttttgcatccatcaatgtcccgcacaggagcaggcccctcccaggtgaggtgggcttggatgcaggagggaagtggtaaagacccctcccagagacaatgcagaattggcctacacgggtggggcattggaagccagctctgggggtactgactcaggaagatgtgcctcagctgagccccgggcattaggaattggctgcaggcatggacagtggacacggagcagggaggcccaacgctacctgcctacaggggagcctgggacgtgggcttctgttccgcagcctgcagagcctgctggagccgggctggtgtcgaggaccacctggcgcccagcaggtccccctgcagcttgttttctgggaaagcaatggactgaatgcctgtgtccccccaaattcatgtgttgaaatcaaccctcaaggtgatggcatttgggggtgcagcctttaggaggtgatggggtcatgagggcggaggctcatgaacggggttactgcccttacagaagaggcctaagggatgcccctctcttcctccacatggcacagtgagaaggtggctgtctgcaagccaggaagagggccctcaccagaacccaactcagctggtaccgtctgcagcttccaaactccagaactgtgagaaataaatgtgtgttgttattaaatcgtcttggtgttttgctagagaagccctagctaaggcaccttccgttctcccacctcttcctcctggggcaaggcctgggtgaggccccgtaagccagcgagtggcttcaagctggtggcacagccagtttcaagccgtctctggggtacgtggcacacacaagagccgggctgtgtaacctgcagcccacggctccacagaggggctgtgccgcccagggacactttctctgcaggtctctggcttcaaccctccttgccgcttgtgtgccggggtgcacttttggggcagctggcagccttttagcctcagctcctctgtggggacagagccaagactgatcgcaaggccaagacctaggagtccaggggaggccctcggctctgtccttcctgccggcccggctcctgctcattccactaacaggcatctccctgatgaaatcctcgagaggttagtcctgtctcggcggcagctgctcagagcaccgggctatcctctggcccctccgaaagcatggccctgaatcactgggggagcctcaccaggcagagatggctcatccccatggacctgggcccccgggtcccggcccccctggcctggccagcacctgacgctgctgtgaggagcatatggtcaaatctgcacctgctgccggccacaagggaggagcaagtgctgagtgcccctgggccacctgaccaagaggtgtccttgtgtcccttgccccctgccccagacgtgcctctcgggaccttcaggccacggtgctatttattacccacttgaggacaaactcggagccaacccacaggcctatgtggcaggactggccacacctgggcccagacacgctgcagctttgcgactccggccacagatcccggggactgactggggttgcaggccttgggccagcccctgaacctggccgtgcctcacagagctttggtggggatgacatgagtggatacattcaaagggtttaaaacggcgcctggcacactgcatccgtgctgctgtgattctatttgagttggtgctttccagatcggtttctctctgtgacgatccagaatctgtgttccgtgcccaggcccaggagtgaggagaggccaacagggaggagaggagggctcctgcctcagggaaacggagcccgtgcaggaggtcctggccgggcagcatggggctcaggacggatgcccgtggcgggtcaccccccacagcagtcacagccggggggcccccaggcctcagggttccacggagcaggttgggcaagtgtgttaggaccatcagcaacctgtgtgcagccaaagacagcaaggacagagccaggaactccggcttctgcctcctctccctgtgccgcctctcctggctgagggctggagagagaaggccacggagcgagagtggcagccctcaagggacgcaggctcagtgctggctgcaggggagctgcgagggcctcaggcgagggagctgcgaggaggccgctgcggcccagtccgtctgttccctgagctgatgacaaaccgtttgttttctgtgaaaggtgctttactgggagaaaggctaacagtgaggcagctctgaagtgcttttattctcagtttcctctgtcgcttaaagaccacttcacatttctttttatttacacggataaggatggatgagcttgatgttctcccaccttcctcttggcgcagctttcttctcctccctcttggaaggactttcgctttttattattattttaaacgttttaaacaacaatctcccaggcgcccaacaaaggcgctactggtgccaggtgcttggcgcctgccttccctgacaatacacgggccacatcctcagcccccccggctggtggcctgtgactcccgccccagtgccagactctttatttcattttgttggcatggtggaaaacactggcttttcaggaggtgaccctgctttcaagagccaacctttggagaaaacaggacacagaagctggttttggctgtgaggccctgacgcacggatgcaggttgcacaggccccacgtcctcctcacagcctgcctttccagctggctcaggagtccctgcggcttgagtttatccagaagcttccctttctcccgcaagagctactcgtggaagagaccagttttaagtgattttgccgcatttgaccttttgggtatttcagtgaaaacaaaacctcttccacaatgcaaaaacttggattcaacaaccatcgattattccctctgggcacctcacagagctggggtgaaggccacctggggttcacgggactcaccgttgggtgttggcattgagtcttgtagagcagggactggcaaagtcagagcacagggcctggtgtgaatcccacctccttccccgactggccaggggacctgcagcaagcgctcagcatctctgagccttagtttcttcctctgcacggggagctcagcggtggcacccacttcatttcagtggtgcccccttagtcatggatgatataaaaatgttgccacaaaagtaaccaagacaggtcgggatgagatatgcacgacttctaaacccaattagggattaattaggaacatacaataaattcccccaattcataagaaaaagacaggaactccggtggatgaatggacagatgatattaataggcaattttcagaggaatttaaagcagcagacagatccatcatacctgccagacaggtgtgcgctgcctggtgtgaccctgctggaggcagtgagggcagcagggatggcagcacctggcggctaggactcggccaagctgaagttcatgcacccgagagccacagcctctgccccagacagggatcagaagtagatttacactcccctctgaaagaacaacaacagagaaaacacacaaagcacatttttcaaaaccctgggcatcggtcgcccgcactccgccaccgtgagtacactgcgtggacccagaaccttgactcctcttgtttctgtgaggctgggacttacgggtgatgtgcagaggggccagagctggtatttagagaggaaatttgggggcaattaaaataggggttctcgacaagtctggcctccccgagcccaggaccaccatagagctctgaacagaggaatgagctggtcgccgtgagaggcggctttgccagagctgggccagggggaaacagcccgttcaatcaggacttggggggtgggactggcttggggttggttggtgtgaggcggggagaaggagatccggaagagtcctcgacggctgacattcacgtcactggagggggccgattggaggggtcagcgatgggctcaattttgtgccctcttgagttcgaggtgtctgtggggcctccagctacagacatttgtgtgttggaaaagctctgcaaaccctgaaacctggggaggcccctggtcttgtctgatggttgtaggtcatggtgacctccactagggcatcttcactcccctgagccacactgagacactgggtttgattgagactctccagccatgatgacaagggttcagctctggtaagccatgtgcagcctccccctcaaagaccagatgccacccacccagggccccaaacatcctggcccagcgggtctgctcactccttgatgagcttaccttcctcgatcaccccaacatgcagagagaaaccctttgcccttcttggagggaggggtcagatgctcactctgcagatccctgaagacaagcagatgctccctgagtggcctgtctgagggattcagctggcagctgggtatcctcatgtgtgcagttcctgagtgagcactggtggtggggaacaggcctggctttccatgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccatgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctcgggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctggggggtgcaggggggatgggcctggctttccacgcctgggggggtgcaggggggatgggcctggctttccacacccggggggtacagcggggatgggcctgtattccacacctgggggtgtatgtccaccacccagatgccacctctgtgtcattcctggagggcattcgggcatcacctgagggtggggagcactgccctgacccacatgacccccagcagaagctgccactgtcggccctgggctccgggtgtcagcgtggcgctctgggcttttcccacactggggggccatttcaggatgtggatccctccaggaagggcttgctgagtggctgctgtttgctgggatgggtgaggggtagacaacaggcactcaggagccatggttgggacagaacttatgtttgtcagccaccttggaggggcgacctggagagctcggacaaccttgcagcacccaccagagagcttagcaccaggacccagcagagctctcccacgtgcacacagactcactgctcgtgtgtgagaaggggaataagtgtgactgagccttctggaagttagggcctagcacagagggtcccagatggcccggagaaccaggtcctgtgcagctatccagagaaggtccagtcaccagagacagacagctggagtgccagggccctggaggtatcaattgcctttgttttacatgaagacattgaacttccacaggagggcaaacgccctggctaaagtaactggcggggcagcgtcaggaactcacaagcccctgtggtccgtgcaggctgccgtcgatttgatgagcacagcaggtccaggcagagagacgctcacctccagctgcggttggggtatgtctgggaggcctgtggggtggctttgctcctccaccttgggccagggtagcctgtggcaaagacagtctcacagtgtgtagtctccttgaggtctgggcctgtccgcagacaggaaataatgagaccggctcaggacagggccgggctggcctctgtgttttgtgaaagttcgagtttctacaccctctgagaagatgctgggccctgagggagggtgtggaccagaaggaagtcacggggtgagtggagggggagggaagcttatgtgccattttaagaagacgacagcaaaaacaggaaaatcgtatttatctgaatcctatgtgattccacttgaattttaaataatttagacaaaagtaaattggcgtttacttttgcattagccataaggagcagaaggagaaatttgctccctagaatatgagtgttgacgtgttgctgacatcaaaacagaatttaaactttgaggaaagagagatgccagtgctgccacaaaggcaccgacgcccgagacagcagggctcgtgtttcttcacgcagaccatctgtgccgccgttggccgtcggaggtgatgaaactgggctgcttccaatgcattccagaatgtaaacccctcaccgtgtttcttcttggtttgatccctggagtgcctgtgctttgtcttcaagtcacacttgggattttgctagttttccaagattatcgcattttttttgaacaaagtaaatcagtttccgacaatgccactgtcgtgttagggtttctcggcgtgtcgcctggctctggccggggttgtgtgtgacgcttcctacccgtgctgccttgcacatttatggagcagggggtttgccggcagcggtcttggttccttataatcctgtcatcgtcctcgtcgtcagccccctccttcccctgctcttcctctgttgtcccagcaagactttcaaagaaccagctattgctcaagtggtcttttagagaatgtgcacacctctcaaccactccacaacacctcaagattgcagtggttgtgtttcgggttcacatacatgtatatcgagactcagggaagtccagggccacacaggaagtggcagagccaagatttagacctgatctagctccaaatcccagcttctctgttgctggccacgcaggatgagctctgtttcccaggcaggctgagcaaatgtccaggatggcaggttcttggcagggccctgggggctgaggccacagaaggcctcctcacaggagtgggggtgaagggccccaggtccaggctggatgaccttctgcccttcctgatgcgggtgacctggctgtgctggtttgaagtaaaaacgctgttggcagagaatcgagacgcggggaaggttagttcagggcagggatgttggtgtctgcgggtgatgactgcagcctccctgtgtgttgtgtttcccggttggcacacctctgtttattgtctgcgccagcctcataccccctttccctcagcgtatttccttcataacaggatggcagactcagcggctgctatggggctgttccaactactgaaaacactgagataaggcccacggtggcagaaatccctgaggctgccaagggtgcccacatcccagatgccggggctctgagagtcgcctcctctgttcttagttgcctcggatgtgaacaggcggccatcagggggtgtcatcctgagccctgaggtggggcctggggtctgcactcgaattcacggtgccctgatgctaagttttaattcttaaaaagcttttctagctcaagatactcctcaatatattaattattggctgaaaaaagcctaaatttttaatcttgcaaatgctagaatttctgagctccctatgttttctctcaattctgctgcaagcttggctttcctttctgagcttatctttttcttgaggtactttatcaaatgcagtagcaatgattattcactctagagacattttgcttggaaagcttttcacccaatgccaggattacattgggtatgtttcctgctttctaagttattacaggagcccatgttagtgattttttttttaccattacatgtcacaagttgccattccccgactttctaaagtagtttattcaccacccagtctatcagccagtgccacatattaatactttaggttttattatggcagcacctacttttggcaccaaattctctattggtcagctattgctataataatgctgtgtaacaaatggccccaccaatcccagtggtttagaagaagctgtttgtctctcatgcctatgtcggtgtagtggccgcagcatctacttcaggctgcaggtgcctctcaggtgtgtggcttggctctcattttgagacctgatggaagaggcagaaggtccccccggggcacttcccaggccaggcgtgcaggagggcaagtggaagcacatacttacctgtactcagaactgcccccactgtccccttccacacttcagtggtcacagcaagtcccatttccaatccatggtgctgggactgggagggaaggaaggactgtgagtgtacaatgccacctgccacaggaatggctcaaggatggaggcaaagttaacaccaggagttgccctgtccctctgctcctgaagcccttggctttgcagagatgatgtggtgcagtggaaaggacacagtgcatggcgggccagctcggctgccctgacacactgtggccagctggcctctcctcggtgtccctggagctgcagctttgatgccagggtagaagatgagtgggaggcggaggggcatttccagccaactctatacactgagaagcactaaagattaacaggtgactgtctgggaagagccagctttgtaagagacactgagaggcaccacttcccaggccttcatcttccctctggatgggtggaggaacagggacaccaaacctgacattgctcccatactgagtgccagccatggccccaccttgcacagcccatgcctcaagggggccatggctagcactatctgacaagaggatgctgggcaggtgggtgggagcagaggaccaggtgaaggctggggcctgtgtaccccagttgaagggagctagatttaactccctgagacccaagaagcatccgtctggccaccccagtctaattggctaggaatttggtggtggcacaggtgagaaggtccctgctccgtggagcttgcaggttctggaaacaaccccaccacatctgttgcaacacctgcagccgtcttcttgcatctttgctttgtgctggacgcttccatatggaacacctaacacaacatctgtagtgggctgagggtaaccctcaaagatatatgtccacatcctaattcccagaacctgggactgtgaccttatttggaaaaggggtctttgcagatttaattaagtgaagggtattgagttggggagaccattcttgtctatctgggtgggctctagtccactgataagtattcttagaagacagaagaggaggaggccatgtgtccacagaggcagaggctagagtgctgtgggaccacgccccctctggcagctcgtgaggggccacgcctcctctggcagctcgtgagggacccacaacagggaggactggggccttgctgggctggagagcccagaggaacaagcagggggctagggcccctgagatgctgtatgactggtccattgttcctgttcctttcccatagaagaaaaaggagagtagtttggggacagattcatgcacatatgcacacatacatactgcacacacatacatactatatacaatacagtgggtatacatatagacacactacagcacatgcacacacacacacattctgcacacaatactgcatgcatgcacatacggcacagcacatacatgcacacatgctgcagcacacacaatactgcacacagagcatacaatcctgcaagtacaccatacacgggtgaagagaaggggcatctgtcagtggcctactcttccagaccctcattttgtccttacagcagctctctggggtgggcctccccaactccctttaatggatgaagatgctgagacttaagggttacaaagtctgcttgaagtcacaaggtgctgcgacttgagctcagggccaggtgaatccctgatgttcctggcaatctgctcctgaagggtgcagcagggcctctctggtctggttctccctcttcctgtaacctttgaggtagtgcctgcaggaaccctgggacccccccacccccaccccaatttgcctgctcctgttccctgggctcagcagagtcaccatcccagccccaggacaagtgtcctccttggtgggggacatgtggtcattgctggggcgatacagtgagatgtggccacacagccatgtccagaccttgggcaccatgctgctcatgctccagactgctggggagcacctggtcctggttgtgtctggctttgggtccttcaatttctgctgtctgctttcctgtcattgctcccacttctcaaccctgccttggtagcttctctgatatgatcaggcaagatcttagagcacagttgcatgtttatattatagcttctctatcactcctgtgggtgtgcacatgttgtatggtgtgtgtgtggatgtgtttctctacgagtacagagcacatatgtttgcatgcattctgtgtgtgcacaaggcatgtttaacatatctggtgtatacacagggtatccataaggtttatgtggtatgtgtgcatactgtgtatggtgtacttgcaggattgtatgctctgtgtgcagtattgtgtgtgctgcagcatgtgtgcatgtatgtgctgtgccgtatgtgcatgcatgcagtattgtgtgcagaatgtgtgtgtgtgtgcatgtgctgtagtgtgtctatatgtatacccactgtattgtatatagtatgtatgtgtgtgcagtatgtatgtgtgcatatgtgcatgaatctgtgctctgaaaagaaagccaacacagtggctggacaacattctaccagtcccttgagactatcaaaagtcagtgtgttcagtcacacagaggagcctttgaagacttcagatgaatgactcaggagcccctcagtcatctcagcagaagacagagataggactatgtgaaaggcctagggaggaccttcttgtgaaatagagtgaatcctgtgtgtgacatacacaggagaccacaaagttcttgagaatgttatatcagcagaaacactgccaacttggactgaagggaacagagaaagtatgaaatgaaagatgaaagagcactgttggactctccaaaattctgcaggaaggaagcaggctgataaaaccactcagtggcaaacatgtgctacctttcatgaaaaaggaaggatgactccaagggtggagccatgagcccagatgttggacctgggacccacagaggattattttctcaggccttgaaatctaatgtttgcttagctggtttttcaaagtgcttgggactgaggactccttttttccttccattttctccctttttgaatgagaatgtctataactgtcaactgatgcctgtcctaatgttgggtctgacagcagatcatttgtttcttgagttttgcaggtttacaggtggagcagaattatgcatctggatggattataccctaacccaaccctaatttacattatgaaatttgggacacttgaactaagtaaatttagatgagatttctggactttgacttaatgctgtaatgaggtagatgttcacagatgctggggtggagtggcatccttgtgagtctttggaagccaggggccaactgtagtcagcaggataatggcccccaaagatgtccacatctcactccccactaccttatatgtcaagagggagtttgcaggtgtgattaaattaagggtcttgaggtgggggattatcctggattaaccaggtggccagtgcaatcatgaaagtcctcacaagaaggaagcaacactgttagcatcagagaagatgtaactacggaagcaaaagtcagagtgatgagtttgctttagaggtggagggaggaacccagaggcatggaagataggtaacctctagaagctggaagaggcacggaagtgaattctccccagagcctccagaaagaagagactcttgctgacgccttggtttagtccagtgaaacccatgtgggacttctgatttccaaaaccataagatgataagtgtgtgttgctttaagccactaagtctgtggtcatcggccgtagcagcaataggaagcaaatacaggcatgaacatcaaaagagcaggagacgggcattccggaagtcgcaggaagaacacgctttctactgctcctgttgggtgttgtcgatcagccaagatgagggctgagaactgatgccagggttagcctttgccggtaacatcggcaaaagcacgtttagtggaataggggaggtaaaatctagcttagcgaggactcaggaaagaccaggaagagaggaagtggagaaggaagactgtgttcttagaggggcatcttgaaaaagagcagagagacagccagcagctggggggccctggccggcaggagaggggacagcatgactgttgttgagggtggccccactgagggggcaaccagagctcctggccagcctggagtgggggacggcggtgggtctggctggccaggcacagttgggtgggaagatggtgtggtcggagcacgtggacattcttttctgattgcttctattttctcagtgagatgggaaacaatcatctcctttttgctaaatgtgctgagcaggcttgagggatgcctggacttcagcaggaagcaatagtcatgcctcgcacatgcggctttcaatcctgtttggttggagaaataatataccgcccaactagtttgttttaaattagacaaacaccccggagcctgcctgctgctggagacggctgtgtttggagtggggctctcggcggtgctgaggtcagctctgtttgacattcctgatgtgtgaagggcgcacttaggacaacaccaccaggccacgggcgtgcagctccctggagctgctccaggggccctgcctgagaaatgttccagtccttgaaatttctccccagttttaaacatctgttggtgcttgtggaaaataaggtcgggattgttgtgctcaccgcccgtgaaagctgccattgcacggtctgtaaagtgctggtgatgaacacttcacaccgacaggctgagcctcggccctggccacgtcgctggggcccagcttctgatcagtctgtatggttcagctctccgtggagttaagtcatgacaaccaaggaacacaggcatttgaggggatagctctgttccctccgccatgtcctggggcgagctgtgtagacgtctgttatcttgataaacccaaacctcttggggccaggtgccctgtgccttcctttgtccttctgtccacctggccttccatgagcctctggggtggggctgtctcctttctctcctgacttcccaaagcacaactgaaagcaaactcttccacccaccatgagtctcattccatctctccagtgggcgagacacgtagtgttttgttttatttcatttgctttgttttttcaatcaagctgaggccagcttggaggcctgttttccttgggatggtggacacatggatctcaggagtttgggggtgccccttctggtcgcaagggaccttctggaccctgtgcctccctcccaccagcctcccctgacaccgcctccgtgctgctcctctcccggtgggctccaccctcactagggcttcaaacctggaatgctctttcctggcctcctgcctgtccccttcccaccaagccccccagttcctgctgagtgccacttcctggctcagctgctcccatccagtgctgggctcagcctcgtcacccacgccccaccataaagggttctttacagcagatggcatcgctgtcggccccccaaccggaggcgcccttcagggcaggagcctgtttcttgtggaagtgtcttaagccctaaaacggtgcccagtgcacagttaaataaaaatcagagccccaagagcaaaccttagcccctcacggtgactacagcccttccaaagaggggccatatcacgtgcacagtgaccctctccacgtgggtcccttggtttgtgagggccttggtttgcaggccatagactgacacagtggcacctggtgtgaggggaagagggtgtggaggccacagacccacacggtggtacctggtgtgagggaaagagggtgtgggggccacagacccacacggtggtacctggtgtgaggggaagagggtgtggaggccacagacccacacggtggcacctggtgtgaggggaagagggtgtggaggccacagacccacacggtggcatctggtgtgagggaagagggtgtggaggccacagacccacacggtggcacctggtgtgaggaccttctgaaggtacccgtgggtgaggggatcatttggatggattgcaaaatggccatgtggctttagtgacacctttaggatgtaataaacttcagagtcaaccttaattctgggagagagacatcttcacttttctggtgccataactgcctctttgtggaacgcaaagcaaaactaaagtcatttttcttgtttgtttttaaggcccttcaggctctagggtgagtttctggtttgaggggaaggcctttcctcctgactccagccctccttgacaaggtctccgtaaagcatgctttctcttagggaccctcagagggaggcttggtggggacatggggtcagggacatcatcaaatgctagacgcccggctggggctgccccgagggctctgagaggagggggcaatcctgcgtggccaggtgggtggtgagtgtgacctgggtggttggcagtggcttccgtccaaggtcctggccaggagcggaatcccacagccacggcaggccattagtggctgagtgaagtttgttcagggtggcctgaccaaaggcaggccctgaggacagctgttgctggctcttggtggaaagaggctgaggccaaagggtttataggtgttcaaattggaaagtggaacaggagacctaagtacgctccctctgaccaggttagggggtactgatggggagtccctcagtagaggcaggggccacctcttctgaccccaagggacccaggccaagaaggagccccctctcccccagggccagggggaccccagcctgccccacactggcactttgcagcaccagggagagaccaggcctcctctgggacaggttccaggcttacgggagctttggtcagaggggcagccacccctgcccactctaagaacgtgaccccagaaaggggcatcatttcttcaacagaagaggaggcgagatgagcttggtgccagttccacggagccacagtgacataaccctccgaacattcgtgaccaaccacggagcacagtgacataaacctccaaacattcatgaccaacctcgattatacagtcacacccagccccgagtggatttaccagagacaggatgttccccaccaggctctcccactaggcagatcctcagcacttggctcaagagtggaacagaccccactagccattgcaggccgttgggcaggcagccctccgacctcagcccatgtgcatatggggtgggggacccgtgggcaaaacttggggtcctaacctgggggggtcaaaccctccacacgcaagtcctggtcagaatcactcagaactgaccctcccctgtgccagcccctcccctgtaccagctcctcccctgtgccagcccctcccctgtaccaagcccctcccctgtaccagctcctcccctgtaccagcccctcccctgtgccagctcctcccctgtgccggcccctcccctgtaccagctcctcccctgtaccagcccctcccctgtaccagcccctcccctgtaccaagcccctcccctgtaccagctcctcccctgtaccagctcctcccctgtaccagcccctcccctgtaccagcccctcccctgtaccacctcctcccctgtgcaaagcccctcccctgtaccagctcctcccctgtaccagctcctcccctgtaccagctcctcccctgtaccagcccctcccctgtaccagcccctcccctgtaccagctcctcccctgtgcaaagcccctccccgtaccagcccctcccctgtaccaagcccctccccagtaccagctcctcccctgtaccagcccctcccctgtaccagctcctcccctgtgcaaagcccctcccctgtcccagctcctcccctgtaccagctcctcccctgtgcaaagcccctcccctgtcccagctcctcccctgtaccagctcctcccctgtgccagcccctcccctgtaccagcccctcccctgtgcaaagcccctcccttgtaccagctcctcccctgtaccagctcctcccctgtaccagctcctcccctgtaccagctcctcccctgtgccagcccctcccctgtaccagctcctcccctgtacaaagcccctcccctgtcccagctcctcccctgtaccagcccccagaccctgaacagcactggccactacacggagccaccaccctggccctggcctgggtgggtgggggtcccccggggagcacagcgcagtgctagggcccctgtagcagattcccaggagacacacacccagctgggcctgctgacactagccctgcattcccacaccccctcccctggccctctcagctgccttgtcctctcctggtcagctgcctggggacactgtcgcgatgcctggcccctgaccttgcccgaagctcctcggtgtctggacattcagcccgacatgctctgaggtttggggcaggtccagcactctgtgggtccaccccatcagccctcagggtgggactcatgcagccacagtttgagagttccaggaaccacaagtcctgagtcagcgggcacctgaccccttatgtcacctgccccaggtggaaggagacgctacagggaccaagcatggttggtaaacgtgtgtgtgtatgtgcactcacgcctgtgtgttaaaatgcttcagagaaagagcagcccaggaacgtgggggttggacgggatgtggaggtgtgggctgtgcctaggggtccctcctggggctgtgtgggtgtgagtggaggactgaggaaaagcctccttacccgggagtgtgtgggggtgctgtttctcgtatactttatttcctgttttaacacatgtgggtgtcctgaaataaaagccgttagccgcccacaagaatgagcaggtttgctggatcacagtcccccacccggtgccaggctgcctgcctgggagactcagggtcctccccaatcctgcctccccacctccacacaagggtgaatctgaagccccaggcacccacgccaggggaactgaggtagagcagacctccagcatccccccgtgacctggcagatggcagtggacattgccctccccagacacccctgtgagttgtcagctctgcctgctggggtggagcccctgacttgggtgagccaagggtgggggggagggtggtgaaccagccggccccccaggtttcctgaaccctttctcagtctcctggaaggggctgaggggcctggcaccttcccaccagagcagtggtccccaacccttttgacaccagggacaggttttgtggaagacacttattctgtgggtgttggagagaagaagggatggtttccctctcagatcatcaggcattagattctcataaggagcggacaacctagatcccttgcgtgcagttcacaataggggtcacgctcctgtgagaagtgaatgccgccgctgatccgagaggaggcggagctcagggtcaggccggtccaccgctcacctcccaccgcgcggccggttcctaacagaccacagcctggggacccctgctccagaggacggggagtgtctctctgtcatccccaacgggccagtgatcccgctggaggggctggggctgcacaggacacaggctcagctgtgctgctggccacccatgacccaatcagaggctcaggtcagagggcaaagatgtccactgaagcggctccagaatccctcaaggaaggtgacatccgcttcgcttcctcctccagccccaccttcgcttccgggaccacagagcccctggagcctgcacgccacggagtctcccactgaggagtgaggaggcctcttgtggggacagatctgggtgagtcaggaggccctgcggggctgggctgggctgggcttaggggctggagcggggagggtttctcagactggagtgggagacttgaggtggagatgtgggttaggtcagggtcaaccctgaaagattgagaatcacacggggctgctcaccttgggcgtgaggagcaaggtctctgggactgactaggtgaagaccggtttcctgggacgggcacgacagggacttgagacccgtcttaggctgtgtcagggcagctgagaaacttgctggcttgtgggtcatggagccccaggagccggtcgaggtgcaggagggggcctgggtggggctgagtcaagggctccggccaagcccctgtggcccaggcggtatttgtttatgcctcatggccgggaggagccactgccttcaccacatcccaccggggtggggcgggtaccaccctctgggacagggaaacttcaagtgggaatttgggcaaatttgaactcagctggattttcagtttgttgttctttgaaggaattcaggactgtgtgccagcgctggccacaccaccaggaggcctggcctggcccgagagggatgccagcttggcatctcccacagggcagggcgtgttgggagccgctgttggctgggggctggcctgagcctgactgcctatgtggagctggcaaggagtgaagaccctgctgccagcacagggccgaggctctccggctaaggacaggcttaggacaggcctaggctctggggtcctcagccccctcccagcagggcccggcccatgctgccagacctgggatgtgcccctggacctccctacctcgggcctctgcccaccccagcctcctcccccagacccctcggtctctgcccctggaggaagccgggagtgtttcttttggaaatgaccccagtttgtggttgttctttgtagacacaccccctgctggggatgagaagtccccctggaccttggtttgggcgggaaaccggctgtgtcccacgttaacctaaatcgtcttttcctctttacgttccagagtcatgcttgaggccaggctcgaatcctgcctgcctttggtggctctgagattcagggctgtcttttctgagagcacccaagtgaggtgccttgggatgcccctgacttggagacacagaggaggctgggcaccccttttccccgacgcactgagccaggtcagcagaggtgctggggcctggcatggcccctgggaaagaacctgctttcctcttgtgggaagtcaaatcctcgcactcagtgccggcaccccttggcgggtgacaagagggcatctcgaaggccactgtgctatgggagttacggctttgactctgagacgggggcctgggtgaggacctggtatcctcaaagtccccgtggctgccctgtggagaagactctgttgggagagggcgctgcctcccagaagtgtcccaaggtccaggaaggaatggggggaagaggacaggagggtgttctcacagtcactgtgacctctggtgagcagagggtccttctcaagctactgaatcctcatggggcttgggtgagggagcgaggataggccaggagccagaggctcaggaggggatggcctcactgtggaaggtgcaggggtggtccagcctgagccctctgccccccgctgcagctcagcaccccccccccacgcacacttacccagggggttgcaaagtgatgggtgttggctctggaactagtcccatgttgtttcccagggaaggagccacacccttctcagacctctgggctgatgcacgaaacggcagccctgcctgggctgcccaccgcccgtcacagaacgatcccgctgcaaatttcacaggcatctggatcgaataacaggctgatagggcgtataaaattagagacagaactctccagaaggcagggtggaggctgcagctccctgggattccacgtgagaaggcagtgatgctgctgcccccacgggaaggacggatgctgagtcagtgggaagacagtgggaagcccagcctggaggggaacgggggacggggtggggggtggtccagaaaaagcagcaggcggttggggtgggacacagggactgtcccgcccggggaggcccccagaccaggagggccagaccctaccgcccctctgcaggaccccatccctgcttcactcccttgctcctagttctgagttgggcccagcctgagtctccaccaggtggacagtagctcctcggggcagctgggtgtgggatctgcaggctcaggcagccacccagatactagcggcctccctgccctccaaaagcccagcctgggatgaaccttgacaaaggccctagaccacagcaaccaccccaccagggctctgagttctccatgaggactggtttccctggaaggtgaacactcaggggctgggacccttaaggattgttcttctcaggtcttcaccgtttccagacgtgtgccttagacatctgcacggacatctcttcccagggatgggcgtctcagggcaggtgcatttaaacttgtgatagagactccaaatcacctctcaaaagcctgttcccattcacacccctgcatacggcatgtcagtggatcccttcctcactggagcaacactagatttagtcataaaatatttttcaatttcttatttctatgattaatagggaggttggatattttgtgatattcattagtttatttgactatgtttctgtttttaccctttaccacttttctagctagtcatttgcttttttcttgttgatttgtgggagttctttatatatgatgaatatcagtactttgtgtttacattgcagatattcgttcccagtctgctgcttattattttacctttttaaggttgttcttttcatcacataaaagtttttaaattttaagtagtcaaatggtttcctttaaggctttggattttgcatttttataccaaaatgctcttgtattttcttccaaactttataattattctttttttttttttttttttgcctttaagttcattttggggcatggggtgagacagaatagcaccatttttccacattaaatcttagatattgtgagccctggaggacacaaattacagcttagaggcctggagcatgattctggagccaggcttcctgggccggagtccacgtcctgcccatggtggctggccattgctttggggagcctctctgagcctcagtgtcctctttgaaagagtggttgttcagagtaagagggtatcttcctgtggacgactcagcttgcgtctcagcccacagtgagcgaagaaccagggggtctcacagagccctgactcaggcgctgagggtccccctaacctccaggcaattcggcctgcacccccacccccgcttcttcttgcctcttctagaagagaggagggtggcggtaaggctggaagggggaagaaaatctgtttcccaaagcctccaggtgattcagccagagtgagaccaaatggcttgggtcttgggttttcagcttcctcacctgtgcggtgcaggtgacagcaccccacttcctactctgtgggcaggtaacacctgcgtgctctgagaaggggaaaacatctccaccctccccagaggcctgcacggccggaggtcacagtgaggcggccacacgccccgggctcttgctccgaggggacgctgtcccaacaagaggccccctcacagtctgtcctgaccctggctctgtggcccctccttctccttgatcaggcccctcccgggtctaccgggatctctggctgccccccgaccccctgctgcagccccaaccctaggtctccacaaagacttcgggatgccccgtgagcccctgggtcctggacccctcttcctcctccagcccctcctctcccagctgctcctggctgccctttaattgctcagagctgttcagcaacctggcgcgtagctggtacataagtggctgttggttggagtcaagtgagtgatggggagatgctaagaagagtgaaagaagcctcggcacccgccgggagcaggtgctgggggtgtgagtgccgctgaatgaacgcgtcctgggacgggatcctgaagcccaccctcccgccgggcccccacaacccagagcgcacaccaaactttctacgtgtctttcccggtcagcctgagcccaaaccacccatgtccctgagcttgtccttgtctgaaagaggagggaagtgtctgtgtcctcaggagcccctggccttaaagataggcaccctggctctggcaggcaggtggcccctggcagcctcgcccacgcccgcggtgactagctctcgggcaagcgatgcaagtgcagaaaccagctctgtgtggtcagtgccccggagctgcagcggcagcagaggtcggaacaccttcctctgtgggcacgccacggaaatttaaagacacagggtgctctttcgcaaaccgggctcgttgattctacaggagaaggtaactattattgagtttcttctttttcagaatgagtggcatccaaacctgactcatatttccaactttattaatttttgcaagacttcggagggtgctctgtggcgattaatattgctgagctgagcacagctgcaatactttcctgtaaaactgactaaaggagaagttggtgtcttcctcatacaagaaatacataaatcagttaaaaatagttctccgagcggatatgatgatgtcgtggccgtcacaggaaacacatgaatcagcctcatcctcagttccagggaagtggggacagtcggtggtccttggacccctcttggggcgcgtgggtgaggcagggtccctctggctttacctcatacccggactggcaaagctgcctgggaggacaactaaaaccatgctcctttgattctgtggacattgctaattgctgggcgttcatttcttgaattcagaccttctcatgaaccagaggagctggctcagaaaaatgccggtgacgcatgggcctgaactggtcagtgcagctcagagatgctcgccgtgggggacgtgcagtttgcctgtgggccagttgtccacccgtcaccgttaccccgctgaggaagctgtgggtgccacccagagagcttgggtacaacacggtctctgctttactcataaaaagccaagacctatgtggtcatggagcgttaaaacagaaatttcacaccacgccgtacggtccccgaggccagggtgttggcacatttcacatccaggaggtgccgtcgctgtcactggctcagcaaagccagtgccgaagccactgcaactgcctgaggcccagcggtggctgggagccaattggtgtcactcggttaccacagggaaggagacgtggctgtagaggcttgtcgcaggtcacagagaagggacttttgggctccaggcctagtgggttcgagtcagcacggtgtcttccccgacaccaaacccaaggaccctcagcacttcctgacctcaggtttctatttctagggtggggagtagaggtgaagggaagcaaagtcagagttgaatataaagctccagaaaaactcagctcagaattgactagagggttgagagcctgagatccctaaggggacatgtcaacccagggcagccgctgagggagattgacatggtttccatggtccttccactgggctggggccctccctggggagtctgtgctgggctggaccttcttccctgccagtggcctctcctggctgggtggggagctccgggggagcagacggcaagagtcttgtttggaaacatgcccttcccaggaaatccccaaaacaaaacctgagaagatctcctggaagctcaaaagcaattttcttttcatatgtcgggccaataagagttaatttcacccagtttctatattttcatgggtccttagaagctttctgaccctgtgccctgagacttagggtctgatggctgaaggaaccttggtcccaggtccctctcctgtggaggggccgtcagagggagagaagagctcgccctggttcacttggcctgtcctgaaagagaaccaggagggagagcagcctagcatgggtgcacacaagcatatgtacaaacatgtgctagggcaactcacacacgtccacatgcatgcacatacacacatgcccacacccatgcacacttatgtgtgcacacagattcagactgtacctgtacacttccacacttccacatgcatgcacatacacacatgcccacacccatgcacacttgtgtgtgcacacacagattcagactgtacctgtacacttacttccacatgcatgcacatacatgtccacgcccatgcacacttgtatgtgcttgcacagattcacacgtgtacatgcacacacacattagcatgtccttgcatatgcacacatacacacatctgacttcacattacatacacacatgtacatgcacatacatgacacacatggctcgaactggaggggagggtcccagttgctcccctcgcctgaccatctagtaagtgttgtgccccatgctgccccatcctgggctcctggccaggctctaagattaactagagaggctctgtccctaagaaaggtcacgcacttcagggtaggtaaggtggacaggcaaggcctggtgacctcggcccatccttgtgcctccagaagccgtaactcacctcaaagaggttttcctgctggagggaactatctctgagcaacaggggcagacttcacagctcaggcgccctcctgaaggtaagaggcactgggctcgcctatcaaagacactctcctgtccccgcaggttcccctatgtcccatcagggagctgggctccaaagtctcccgccctgcttctcctagagaatgcaaaggctgcctctcttccctcccagtgtaacctgaccctcctctgtgccccttggccacccttgcatcctctagctccttctgacaccttctttttgactgttcacagagggcaggatctgaagcctgcagaggtgacccttggtgccttgtgcaaggctggccagcaagtaagcatgacttttggctctgctgccagctgggccatttgatctacacacacttttctgcctctacctggagttaggcgaggctctctatagaatgggtacttgtcaacaaagtgggcttagactccgggcagtagcagttgaggcaggagcagtgggagaagtctgggctaatggcaagcacccagtcccctctgtgagctgcccacttgtcccaggctctgccatggcccttcctctgatttttaggagctttcatgaggcctcgcacagcctgaaggagcagagcttgttgtgctaatccccagcatcctctgcagagttctcaacaccttgtggccgaaaggtccttcagattgtccaggcacccaccccgaaaaccagccctggcatgggggtgctgacccctcccggagcagtggggtgcagggctcataaggcggggtctgcaaagcatgctggggtcttgctctgtgcttactccaaggatgcagcccggagtgccactgctcttggactttccttgaggtgggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcctggctgtttagtttattcttaccagaattggatgtggacagtaccgtcctttacaaatgattcttatcaagtacataatgtgttcagtagcaattcttttcaacttctgttaaacttaatccacaagaggaatggtgggttctggtcactactaacagcaataaaacaaaaggactgccagactgcccaaaggaatctacaaagggaccttttctggtgaattcaattttatggaataattgtaatgccattattggcgggattgctccagccagaatacgacatgctcagagttcaattatttgttacaatattagaggacggatggcagtcctacaggttgagagaatgggtgtctccttacccattcaaatggatgaacacaggcattgttccttctagaccaaaaatgattcatcccattgttaccccagaacatcctgaattatggaaattagctgcagctatgacaggaataaggatatggagtgctacctatcaactctctcccactaatatcaaaacacccacattcaacatcaccttgatgtctgaacaggtgatacgtatcaggagctgtgtcaaacccccttacatgctgttggttggaaatataattatcattcccaatacacaaaatatagaatgtgataattgtaagctgttcatgtgcattgatgctacttttaatcccacaacaagtattctattcgtaagggctagggagggggtatggataccagtttctttacatcatccatgggagtcttccccctctatacacatagtcaatgaagttcttaaaggtatcctgaaaagaacaaagtgatttatttttactgttattgtagtcattgcaggtctaattgcggtttctgcaacagcggcaaccgctggagttgagatccacagttctgttcaaaccactcaatatgttgaagcatggcaaaaaaactcctccagactttggaattctcagactcaaattgatcaaaagttagctaatcaaattaattatctccaccaaagtgtaatatggctgggagatacagttatgaatttggaacaccgtatgcaattacaatgtgattggaatacttctgattactgtataacaccttatgcttataataaagatcagcatagctgggaaacggtctcaagacatttaaaaacctgggatgataaccttggatatttcaaaacttaaagaacaaatttttgaggcttcacaggctcatttatccactgttctgggctcagacatttttgaaggaatagctaaagaattatctgatcttaatccctttaaatggatcaaacccctcagaggatcattgttgtcactggcattattaatattggtatgcttatgttgtctacttttagtctgcagatcccgcaaggaatccgaagacaagtccaaagtcaacgacaagcaatgatggcaatggtgatcctagttaataaaaagcggggagatgtgggtggcaagccacccaggtgccgaggcaagagaccgagagcacgagctgttccagtgtaataaaatatataaaataacaagagttatactgatatagctcatagatatgattatatataaataccattaatcattagtttgtagtaattactctttattcaaatattataataatcctcactctacaatcataacctagaaaaaggcaggccatgcagagataggagctgaggggacatggtgagaagtgacaagaagacaagagtgtgagccttttgttatgcccaggcagggccaccagagggctccttggtctagcagtaatgccagcgtctgggaagatgcccgtaccaagcggaccatggtctagtggtagcgtcagtgccaaggaaaagcacctgctactgagcagaccaggaaagggagtctccctttccccaggggagtttagagaagactctactccaccatctcttatggagggcctgacataagtcaggcctgcctgcagttatccagaggcctgaccgtctccctgtgatgctgtgcttcagtagtcatgctcctggtctgctttcatgttccatcctgtacacctggctctgccttctagatagcaatagcagaattactgaaagtattaaaagtctctgaaatgcagaaataatggtgtaagctgtctctcctctctctccgcctcggctgccaaacagggaagggctccctttccagtggatgcatgacccacgtgaccttacctatcattggagatggctaacactccttaccctgcccccttgtcttgtatccaataaataacagcgcagcctggaatttggggccactactggtctccacgtcttggtggtagtggtcccccagccccagctgtcttttcttttatctctttgtcttttgtctttgtttctatgatctcttgtctccgcacacggggagaaaaacccacagaccctgtagggctggcccctacaggctctcaactgtgtctctgttcagccctgctgtagggctctcaaccttctgcctgtttggcctggcaatgaggccctcaaccctatccctccacagcctggttatccatctctcacttctgcttctcctttggtgcatcaggctccctcgaagcctgtcctgcagttactgcagcagccttgatttctcaaccctaaaagacctgcccagcaggtaatcgcacctcatcctggcttacaggttcttgattcttcctctatccaaaactcgaatctctttttggcttctggtccggttaccactgctgttgccaccaccatggctgctcataagcaacaggttacatacattcctgaaaatgacactcctcttatgagagccatttctcaagccagggagtatgggcatcctgaggcctagcaacttcctcttattctacatccccatatacctgccgctcctgttgctgtggcacaggatcagccacagcccgctgatcctgctcagcaggtggctgatcacacggctccccaaggtccgcagcctgaaaatcaggctcctcaggcaaataatcaggctcctcaacctataccataaatgcttgctgctgtagcgcagccagctccaggtatacctgcagtccaggcagtagtccaaccagatccttttcatccaggccaggtccagttactccctgctacacgggaaagtttttcttttaaattcctcaaagatttcaaagaatcagtgaaacaatacggcaccaactccccttttgtgcattccacattaaaagctctagcagaggataaacgtttggtgccttatgactggggaattctagcaaaatcagtattatctgaatcccaatatttataattcaggacttggtgggttgatgctgtccacgatcgagttcagcttaatcaaggctctaatcctcctgttaatattacagctgaccagttattgggaatgggacaatggcctgcaattacaaatcaaactatactaaatgatgaggtcattcaacagcttcgcaaatgctgcctatatactaatagtagtgcatttataccagtccctaacgatgacaggtttcccgctcaaccagaggaagaaggtatgcagtttaatttgtcaattggatataaatacccgccattgtgcataggaatgtcacctggctgcttagctttctctaatcaaaattggatatggactgtaccgtcctctaataatgattcttatcaagtacataatgagtttagtagtaattcttttcagatcatgactgttaaacttaatcctcatgaggaatggagagttcccgtcactaccaaacataatacaacaaaaggactgctagactgttcaagtgaacctaccagggaaccttttacagttgaaactattgtatggaatgattgtaatgctccaaaagcagtagtgttacagcgcctgattacaggtggttattgactgggcttcaagaggatattattggctaaatttttccagcctaaatgccaaatattctgagttcaactatttgatagattatgtagaggagggatggcagtcctacaggctgagggaatgggtgtctccttacccattcaaatggatggacaaagtgatcattcctcctagaccaaaagtgattcatcctattgttaccccagaacatcctgaattgtggaaattggctgctgccatgactggaattaggatatggaatgtaacctatcagatcactcccactaataccaagacagacgtatacaaagtcaccttgatgtctgaacaggtgatacctagcaggagctgtgtaaaatccccttatatgctattagtcggaaatataattatcaccccccaacagccaaaccatagaatttgatgattgcaaattgtttacatgtattcgtgttacatttcatcccataacaagtattctcctggtaagggctagggagggggtaaggataccgtttctttacaccacccttgggagtcttctccctctattcatatagtcaatgaaatccttaaaggaatccttaagagaacgaagagattcatctttactcttattgcagtcattgcaggattaattgctgtcactgccacagcaatggcagctggagttgctatccacaactctgttcagaccactcaatatgtggaagtgtggcaaaaaaacaaacaaacaaacaaaaactccaccagactctggaattctcaggctcaagttgatcaaatttggctaatcaaattaatgatctccaccagagtgtgatatggctgggagatagagttatgaatttgcaacaccgtatgcaattacaatgtgattggaataattctgattattgcataatgccttatgcttataaaaaagatcagcatagctgggaaaaagtcatgagacattcaaagcctgggatgataatctaacttaagatatttcaaaactgaaagagcaaattttgggggcctcacaggctcacttaactaccgttcctggctctcatatttttgaggaaatcaccaaagtattatccgatcttaatctttttaaacggatcaaaccccttagaggttcactattgtcactagcattactgatattggtgtgtttatgttgtctgcttttagtatgcagatgtcttcagggagtccgatgaaaagcccaaagtcaacaacaagcaatgatggcaatgatgatcctagtcaataaaaagaggggagatttgggcagctgtggacgaaggattacccaggtgccaagacaggagactgaaggcacaaactgtagcagtataataaagaaaatagttagaataaagaatacttacaatacaaattagatatagagatgatcatggacaattatcaatcaataatgtataaacattattaatcattagcttttaatattagtctttgttgcattactaatataacctaggaataattgatgggtgtaggatcatgtactgaagggacattgtgagaagtgacctagaaagcaagaggtgagccctctgtcatgcccacataagggccggttgagggctccttggccaagcagtaatgccagtgcctgggaaggcacccgttacttagcagaccaagaaagggagtctccctgttcttggaggagtcaggaaacactctgcttcaccacctccttgtgggaggctttatattatccaggcctgccctgcagtcatctggaggcctaaacccctccccgtggtgctgtgcttcagtggtcatgctccttgtccactttcatgttcctcctgtactcctggttcctctttgaagttcatagtagatagtggtagaagaaatagtgaaagtcttaaaatctttgaactttcttataagtgcctagaagaaaacactgatgtatgctgcctttcctctctgcttcagctacctaaaagggaagggccccctgtcccatgatcatgtgacttgcttgagcttatcaatcacttggacgtctcaccctccttactctgccccctttgtcttgtatgtaataaatatcagcgagcccagccattccgggcccctactggtctctgcgtcttggtggtaatggtcccctgggcccagctgttttctctttatctctttgtcttgtgtctttatctcttataatctctcatctccatacatgggtagaacacccactaaaccctgtagggctggaccctacaggcggcaagctacccaggtgctgaggcaagagaccgaaggcacaagatgttccagtataataaaatatatagaataagaatagttatactagaaatagaatacagatatgatcatatatgaatattaatcattagtttgtagatttactctttattccaatattataataatatctgttttacaattataacctagaaaaaattaggccatacagagataggagctgaaaggacacggtgagaagtgaccggaagacaagagtgtgagccctctgtcatgcccggacagggccactagagggctccttggtctagcggtaacgccagtgcctggggaggcacccgttacttagcagactggtctagtggtagcgccagtgcctgggaaggcacccgttacttagcagaccaggaaagggagagagttagagaagactctgctccacgacctcttgtggaagatctttgtcaggcccacccgcagccatgcccacagccatctggaggcctaaacgtctccctgtgatgctgtgcttcagtggtcacgctccttgttcattttcatgttccactctgtgcacctagcctggccttctagacagcggtagcagaattagtgaaagtattaaagtctttgatctttccgagaaatgcatagaagaaataatgacgtaagctgtcccctctctgtctccacctcagctaccaaatagggaagggcccctgtccagtggtcacgtgactcacgtgaccttacctatcattggagatgacctgcactccttaccctgcccccttgccttgtatacaataagtaacagcacagccaggcattcggggccactaccggtctccgcgtcttggtggtagtgttcacccgggcccagctgtcttttattctatctctttgttttgtgtctttatttctatgatctatcatctccacacacaagagaaaaccccaaaggccctgtagggttggaccctacatctggcgcccaacgagaatttctctctcgctgtgtgaagttgcactttgagcgtgaaacacagcagaggatttcaatgacagattcctgaggattgaggtcaataagcttggtggtaagcttgggcactcagagtatcccagggacaccaagggacaggcctgtactaagtactcagcttatttaaattttataaaaactctccttaaagaaggagtggttaaaagtatctactgataagttaattgaactgtttgatgttgtagatcttctttgcccttggtttcctactgagggaactttagaacttaaggattgggatgagattggcagacattcaaaattgctcataaaggcgggcatattattccacccccaatttggtcaatctgggcttcggttcgctctgtcctagactctttacagactcaggaggacaacatggagactgatccctctttcctctgaggaggctgaggaagtgcttagttctttttcacctgaggatactgcacagattgaggccatagttctacagatggacctccactctgatattcctttggtgccaccacctacgccagagcctaccatgccccagttatcgctttatgatgaacttttaactgatctgaatgaatttatttcccccaaccagcaaaatccagctgaaagatattatcaacagccatcacagctgtaccctcctacctttcctcaaactctcaactctccagctatgcagatagaaaatgagatgatgcagcctgaaaaagaggctctaaactatgttttcatgcagcctggtacagaggctccaatttctacacagcccggtgaagaggctctcaattccctgcctggtaatgaggccctgaaccctatccctgttcagccctgctgtagagctctcaacttcttgcctattcagcctggtaatgaggccctcaaccctatctctgttcagccccgctgtggggctctcaactttctaccagttcagcccagttatgaggccctcaaccctatccatattcaacctatttttccacctctctcttctcgttctcttttgacaagtcagtctcccttgaagcctggacctctcttggtaaatcaggctcccttgaagcctgggtctctttcagaaatcaggctcctttgaagcctgggtatcttttggcaaatcagtctccctcgaagcctgggtctctttcggcaaatcacacttccttgaagcctgggtcttttctgacaaatcaggctcccttgaaacctcaggctctcttgaagcctggtccacagttactgcggcagcctcaggcccatgaaagacctgcccagcaggtaatctcgtctcatcctggcctacaggttctcaactcttcctccattcaaaattccaacctttttcctgcttctggtccagttgctactgtggtggccaataccaccattgccgctcataagcaatgagctatatacatccctgaaaatgacactccttttatgagggctatagctcagacaagagaatatggggatcccgaagcctggcaatttcctgtaattttacaacctccaatacccgccgtcccagtggcacaaaatcagccacagcctgctgatccttctcagcaggcggctgatcccgcaacccgtcaagatcaacagcctgacaatcaggctgctcaggaaaataatcaggctccacaactgcctgccgctgagacacagccagttcctgatgttccagtagttcaggcagtagttcaacctgaccctatacatccaggccaggttcagctatgtcccgctacttaggaaagtttttttttcttttctttctttttttttttttttgagatggagtctcgctctgtctcccaggcatgcccggctaatttttttttttttttttttttttttttttttgtatttttagtagagacagactttcaccctgttagccaggatggtctcgatctcctgaccttgtgatccacctgcctgggcctcccaaagtgctgggattacaggagtgagccaccgcacctggccaagtttttcttttaaattcctcaaagatttcaaagaatctgtgaagcagtatggcaccaactccccttttgtccattccaaattaaaagccctagcagaaaataaacacttggtgccctatgactgggagattttagcagtcagtcttatctaaatcccaatatttacaattcaggacttggtgggttgatgctatccaggaatgcattcgtctttgggctctaatcctcctgttaatgttacagccgaccaattactgggaatgggccagtgggctgcaattcgaaaccaaactatactaaatgatgaggttattgaacaactgtggaaatgctgcttagatgcttgggacaagattcaagatgatgacaaactatgcccatgttttacagccgtcagacggggacaacatgaaccgtatccagactttattgcccatcttcaagacgcagcagaaaaagctatccctgatagccagggccaatgacttgttatagaacttatggcttatgaacaagtaaatccagactgtcaggtggctatttgccccattaaaggcaaaattccaccagggggtgatgtactcacctcatacattaaagtctgtgaaggcgtgaggggaactctgcgtacagcaatggtcatggcacaagccatggtctctattcgaatgcctggacaattccctggcaaatgcttcctatgcagccaatcgggatattctaaaagaaattgtccttggcatacaggccgctgttcttttcaacaccaacaaccaaaattttttcaacaacaagccccactttctactatatgcccacgatgccaaaaaggaaatcactgggtggctcaatgccattcaaaatttgatattgatggcaatcccttacggtcacttccaggtaaacgggaagaggggccagccctaggcccctccaaacaatggggcattcctcaactctgagcccctggcgtccagcaagatgagcgccttgccagcccaatccattcaacgtacatcccaattcccacttcagcaatttgtgccacaggatctaatggctctgccccaacacgaatctcagtacaatgcttgtcccctgccaccacaggctcagcatcagtagatctctgttgtaccagagatatttctctgttacctggagagccacctattgctgttcccacaggtgtttttggccccttgccgactggcagtgtcggtttgctatttgatctctcaagcctaaatttaaaaggtgttcaagtacatactggtgtaattgattctgactattcaggtgaaattcatattgtcattagctctgcagtcccttgatatacggcagctggagaccgcattgctcagcttcttatactcccttacgttcctttaggatccagttcttgtaccagaactggaggttttggtagcacagactatcaggacaaagcagcttattgagccagcaagatttctgacactcgtcctgtgtgctctgtgcatattcaaggaaggaagtttgagggaatgattgatacgggcgctgatgtctccattatcgctttacatcaatggccccgacactggccaaaggaacacgcgtccacagcattagttggtgttggtcaggcttcagaagtctatgaaagttctacaattttacactgtacgggcccagaagaacagattggtactatttgccccctcattacacccattcctgttaacctgtggggaagagaacttttacaacaacgaggggcacagatttcttttccacaaggcaattacagccagcaaagtaaagacattatgacaaaaatgggatttgttcaagttatgggcttagggaaatcagcacaaggcatcaccgagcctattatacctacccataaatcagattttacgggacttggttattctttttagaagtggtcactatcaagcctccaaatcccatccccttgacttggaaaactcagaaaccggtttgggtaaatcagtggccgctccctaaaaataagctggaggcactccatattttgatccttgaacagttaaaattgggacacatcgagcaatctttttctatctggaattcacctgtctttgttatccaaaagaaatccggtaagtggagaatgcttactgatcttagggcagtaagtgctgtccttcagcctatggggacattacaacccagcttgcctttccccgctatgattcccaagtattggcctcttatcatcattgatcttaaagactgcttcttcaacattcctctggcccctcaggactttgaaaaatttgctttcacagttccaacccttaacaacatcgctcccacagcacgttaccattggaaagtcctacctcagggaatgcttaatagcctaccatttgtcaatattacgtggggagcatattaaagccagtaagagatcaatttccccaattttttatcattcattacatggatgatattctttgtgcagtgccttcacgttctgtattaatatcttgtttctctgcagtacgacaagcagttgcaacagctggtttggctgtcgctccagaaaaaatccaaacttcttctccttatcaatatttaggaatgcagctagaagacaaggttattaagccccaaaaggttcaactcagatgagactctctaaaaacgctaaatgatttccaaaaaatgcttggagatattaattggatttgcccctccttaggcattcttacatatgctatgtctaatctgtttgcaacattatggggcaatcctgatttatgcaacaaaaggtctttgacccctgaggcagattctgaattacaacttatagaaaaacgcattcaacagtctcaggtaaccagggcgaatccatatttaccttttgaaatactaatctttcctactaaacattcaccaacaggactcattatccagggacataatttaattgaatagtgctttcttccacacagctctttacggacgcttaccgtttatctagatcaaatttctatcctaattggtcaagctctttctcaccttcttcatcttttgggtacagagccccaaaaaatcattgtttccctcacctgattacaagtccaacaggcttttgcaacctgcattgcttgccaagtacatttggcaggtttcctgggtataattgacaatcattatcctaatgtaaaactatttcagttccttaaacttacttcttggatcttacctaacattactatggatactccattagctgaagctgtcactgtttttactgatgcttcctgtaatgaccaaggagcatatgcagggccaaaagaatgtgtccttaactcaggagctacttcagcacaacaagctgagctgactgctgtcatggctgttcttgaatatttccctgaaccagttaacatagtttctgatttggtgtacgcagcaggtgttgcttgcaacattgaaactgccttaaacacatttctgcctgatgataaccactttttcttttccaaaagtttcagtccctactcagagcaaggtcttctcccttctacattactcacgttcgggctcacatgcccctccccgacctctctcagcagcaaatgccagcgctgatacattagttgctcccatttttatggacgtagaaaattttcacgctgtaactcaagtcaatgctgcgggactcggaaaaaagttctgcttcacatggaagcaagctaaaaccattgtatgtcactgtcctacttgccaagtgttaattttacatccactttcttcaggagttaaccctagaggactttcacaaaatattctctggcaaatggacgtgactcattatccagctttcagcaaactctcttttatgcatgtaactattgacactttttctcattttatctgggccacatgtcaaacgggggaaagtacggctcatgttaaacagcacatggtttcatgtttcttggttatgggatgtcctgagaaactaaaaactgacaattttctggttacattagcaatgattttaaaaagttcactcagacatggggaattactcacacaactggcattccctataactgtcaaggacaggcattggtagaacgagttaataaaatgctgaaagaccaactttgaaaacaggacactaaagagaagaaggatgctcctacccccatactcagttaaattttgttctttttacactcaatttcttaaacctagcaagaaatcaaccttttacagcagcagaacaacatttcactggaaacagatttgatccacaaaaaggaaagtgggtatggtggaaggatacaaaaactgacaaataggaattaggcactgtggtaacatggggtaggggtttcgcttgtgtttccccaggagaaggacaacaacccgtgtgggttccctcccatcaactgagattgcattttaactccaaggatgaagaactctcagaaacaaaaggcaaagaagcctcagaaatcaaagagcaagttttgccacctgacacataaattccatgacctcgacattacaacaaaatctcaccgtgtgacctccaacacaagtcattctactctaccaacatggggccagataaaggtcttatcccatcaaacagagaaataactacaagaaaaaggaattccaaaagtgacgggtaatataattctggctgcctttatggtggtcagtgcagtggtgagtataccaggggttggggcaactcaaaattatacctactgggcatacattacttttccccctttaattcggtctgtctcctggatggactcctcagtggaagtttacactaataatagtgtcttcatgccagtccccaatgatgacaggtttccagctcaaccagaagtaaaaggtatgcactttaatttgtcaattggctacaaatatccaccactgtgtattggaatgttgcctggctgcttagcttattcttatcagaattcgatgtggaccatacagtcctctagtaatgattcttatcaagtgcaggagcaattcttttcaactcatgaatgttaaacttaatccacatgaggaatggagagttcctgtcactactaaaagcaataaaacaaaaggattgccagactgctcaaaggaacctacaaagggacattttctactaaattcaattttatggaatgattgtaatgctccaaaggccgtagtgttccaaaatctagctatgggtgctgttattgactgggccccaagagggtattattggagaaattgctctggctaaaataccaaatgcttggagtttaattatttgttagattatgtaaaggactgatggcaattctacaggttgagggaatgggtgccccttatccattcaaatggaggaacacaggaatcgttcctcctagaccaaaaatgattcatcaaattgttacccctgaacatcctgaattagggaaattagctgcagccatgacaggaataaggatatggaacgctacctatcaaatctctcctactaataccaagacactcatattcaagatcaccttgatgtcaggacaggtgatacatatcaggagctgtgtcaaatccccttacatgctgctagttggaattataattattactcccaatacacaaactatagaatgtaatgattgtaacctgttcacgtgtatcgatgctacttttaatcccagaacaagtattcttttgataagggctaggaagggggtatggatataatttctttacatcatccatggaagtcttccccctctatacacatagtcagtgaacttcttaagggtatcctcaaaagaaccaagagattcatttttactcttattgcagtcattgcaggactaattgccattactgcaacagcgacaaccgttggagttgctatccacaactctgttcaaaccgctcaatatgtggaagcatggcaaaaaaaactccaccaaactctgaaattctcatgctcaagttgatcaaaaattggctaatcaaattaattatctccaccagagtgtaatctgactgggagatagagttatgaatctggaacaccatatgcaattacagtgcgattggaatacttctgattattgcataagaccttatgtttataataaagatcaacatagtggggaagaagtctcaagacatttaaaagcctgggatgataacttaaccttagatatttcaaaacctaaagaacacgtttttgaggcctcacaggctcatttaactactgctcctgccttgggcagttttgaaggaataactaaaggattatctgatcttaatccctttaaatggatcaaacccctcggaggatcatcgttgtcattggcattattaatactggtatgtttatgttgtctacttttagtctgcagatgtctccaaggaggccgaggacaagtcccaagtcaacgacaagcaatgatggcaatgatgatcctagtcaataaaaagtggggagatgtgggtggtaagccaccgacgtgccaaggcaagagacggagagcacgagctgttccagtataataaagaaaatatttagaataagaatagtcatactagaaatagaatatagataggattatatgtgattatatgtgaatattattaatcagtttgtaacattactctttattccaatataataatctctgttctacaattataacctaggaaaatctaggccatacagagataggagctgaaggaacatggtgagaagtgaccagaagacaagagtgtgagccctctgtcatgcccgggcagggccactaggagggctccttggtgaagcggtaacgccagtgtctgggaaggcatccgttacttagcagaccaggaaagggactctgcctttccctgcggagtaagagaagactctgctccaccacctcttgtggaaggcctgacattagtcagacccgcctgcaaccatgcctgcagacatccggaggcctaaacgtctccctgtgatgctgtgcttcagtggtcctggtccactttcattttccgctctgtgcacatggccccgccttctggatagcagcagcacaattagtgaaagtattagagtctttgatcttcccaagaaatgcaaagaagaaataatgacgtaagctctcccctctctgtctctgcctcggctaccaaacagggaagggccccctgtacagtggatgcatgactcgcgtgcccttacctatcattggacatgactcgcactccttaccctgtccccttgccttgtatacaataaataacagcgtagctaggccttcagggccactaccggtctccgagttttcgtggtagtgttcccgtgggcccagctgtcttttctactatctctttgtccggtgtttttatttccatgatctattgcctccgcacacaaacagaaaaacccacaggccctgtagggctgcaccctacagaaagccatccagatgccaaggcaagacactgaacgcagaagctgttcaaatataataaagaaaataggataaaagaaagttatatcagacataggatacagagatgattacatatggatattatcaattattagtttttagtattaatctttgttattataaccgaggaaaaaacaggccatacagagtaagaagtagaggggacaatgtgagaggtaaccagaagacaagagtatgagccccctgtcatgcccggataacggctgcttgagggctccatggtcttgtggtagtgcctcttcctcggaaggcacctgttatttagaaaactttggtctagcggtaatgccagtgcctgggaaggccctggttacttagcaggccttggtctagcggtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtacacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactccgggccactacctgtctgtctccgcgctttggtggcagtggtcccccgggcccagctgtctttcttcctatctctttgtcttctgtctttatctcttcgatctctcgtctccgcacacacacgaagagaaaacccacagacccggtaggggtggaccctacattatctcagctacaacataatcaagatattcacgtggactactgagtctttcggtgcccccttgctgttttagttttgtcctgcggccgagtgtttccctcgcttcacgccaacccaatctccgccgccctgtcttgtcatccccattctacagcccagcacggtgtagtatggcagccgctagccacaggtatctagggagccctggaaatgtggtcagttctaatggagctgcgctgttaagtgtgaaatacacatgggattttgacggcagtgggagcaaaattctcccaatttttttttttttttttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttggtcaggctggtctccaactcccgacctccggtgatctgcccagctgccgcctcccaaagtgttgcttgcgattacaggcttgagccaccgctcaccctggctttttttttttttttttttttttttttttttttttcagacaaactctcgctctgtcgcccaggctggagtgcagtggcgcgatctcggctcactgcagcctctacctcccgggttccagcgattctcctgcctcagcctcctgggtagctgggattacaggcgcaggccaccacgcccggctaatttttgtatttttagggggtttcgccatgtcggccaggctggtctcgagctcctgacctcaggcgatccgcccgcctcggcctcccaaagcgctgggattacaggcgtaagccaccgcgccgggctctttcattctgtctttattttctgagatagagtctcgctcggacgctcaggttggactgcaacggcgtgatctcggctcgctgaaacttccgcctcccgggttcaagcgattctcctgtctcagcctcccgagtagctgggattattgacgggcagcaccacgcccggctactttttgtggtttttgtatgttctgtcttctgctctttagtaccgcatagagccgcagaagactagcgagtcgaacaaacggcccctcttgcagcagttgttgatcacggggctgccccccggtactcatcctgtgtctctcgtccaaatccccgctcctcctcagctatcacctctgccgatgctagtggtttccctgggtaccgggaaccaaactctcattccccaggggcctaagccccccgtggccaggcccttctcaagtcagggttcctgcacattcacagttacgggtggccctgggagtaacacctggcacccaaacaggtcaccagagtccacacatagtccacctgccctccctgcgtaagatcagctcttcctcctcccgacgatagatcagggtcaatgatccctgccaagatggcgactgctccagcctgctggtccaacctgtccagccacagctgttgctcgaaggcttgaagttcaatgggaccctctcccgctttctacaaactggttcctttatttttatgtttatttatttgggacggggtctggctctgtcacccaggctggagtgcagtggtgcaatcactgctcactgcagcatccacctcccagcgtccacccatcctcctggcctcagcctccggaacagctggggtacaggtacgccccagcccgaacaggttttcactaggttgcctgggctctttctttctttgtctgtgtttgtttgttggttggttggttggtttttgtttgtttgtttcgagacggggctccggctctgccgccgggggctgcagtgcaatggcgcgatctcacctcactgcggccttctgggctcaagcgatcctcccactgtgcccggcctgaagacagcctttagagaaagaagcagggggagttcttccgaggacagacaagatttctggagtttggaaagggtgagagactgggtcagcgaaaggaacattccggtctttatgttgggatgcaacgtatagatacagggatgagacccaaaagagccggcagaggtttgtcatcgtgctcgcaaggcaactgccggtggctgatcccgtaaaggatacacatacctagagcggagcctaaagatgcatccagcatgacgggtggagccacgatgcttggactcgagctctgctcctgtgcgttccgtgatcaatggcttatactacctgcacctcagtttttcccgggcaaaaaaggaagcttgctgccggtgcgttggcacctgccttaaagtgccagctactcagcgggctgaagaggaagaagttcctactaggaagacacgtggacacgtatgtttactgcagcactatttacaatagcaaagacttggaaccaactcgaatgcccatgaatgataggctggataaagaaagtgtggcacgtatacagcatggaattactacgcagccataaaaaaggatgagttcatgacctctgcgggaacgtggatgaagctggaaggcctcattctcagcaaactgacacaggaagcgaaaaccaaacaccgcatgttctcgctcctaagtgggagttgaacagcgagaacacatgggacacagggaggggaacatcacacgccgggccctgacggggcgtggggggcaaggggagagagagcattaggacaaatagccaacgcatgcggggcttcaaacctagacgactggtggataggtgcagcaaagcaccgtggcacacgtgtacctatgttccaaacctgcacgtcctgcacatgtaccccagaacttgggagggggtgggggaaaccaaaagagagagcgagggagaggcggggagggggggggaaagagagagagagacagagagaggagagagagagagagagagagagagacagagagacagagacagacacagagagacggagagacagagagagagagagaaagagagagagagagagagagagagagagagagagagacaggagaaagaagaactccgggtgggtcccattcctttaaaaggtcgccacccactcgactgccaagctgagatcctaaggacctccccaaaggaggaggtcgtggccttcccaaagcgcagtagccacggtggaaacgaaagcgtgccgcataagcctaccgtctaccgcccgcacatcaggaacctcacggtacttcagggaagcagttaagtcaagccggcgcgtcacaggcactcggcgtgcaagccgccccgcaggtgctaccgtctctcacctccctctacttttaggaaacacgttgtatccccggagggggtgcaccgttcctggaggtactgcaacaccaggtcgatgcgtggagtggacggagcaagctcctattccatctccctgctccaaaaatccatttaatatattgtcctcggatagaggacgtatcagatattaaactgataagaacagatactacacttgatcttagccgaaaggccgagaagcgatgcgctcgccttcgcgcccgccgtcaccgtcccactctcatccacattcaagtcgcggtgagagccccagcctcgctccttgccccattccctctgtctcgtccacagcgctattgacgcccttacactctcgggctgatttcttattctccgcctttgaaaagggaaatcttacacccgtgcttcttccggcgttcccgggctttcatttcgaatttgcatgccccgccctttcacagagggcgtggcctccgccgttgactccgcccccggggccgcctctgcctgggggagccggggctccgctgggggcgacttccttgttcgtatcgagccagcgaaaagacagaaccggaagagaccgggggcgaaggcgacaggggtctgtggaagagacctgtcggcggagagcggtccacgttttcctggagaaagacgaggccccagggcaggagcgcgggctgcgctgggcctttacttcgccgcccgcgggcggggagaccggccccgtacccgaggggacgaggggacgaggggcccatgcccagtcagggaagccgaaggcctggaggggcttccgggagcaggggctggagttcctctgccaggcaggaggctggcaccagacacccggcagagggaggcggcgagggcccagcaaggattctccccagcccctgtgcctgcgtctcctgcggcttctgtgcgcggaccgtgtcctgggctgtgtagggaacgctgcctctctgctcgggacgtggattcctttcccctcctcctcgcctggctacttctgacgcaggtcgtcaggactccgcttgggtgtcacccgtgcaggaagcctcccttagtcaagggccctcggcacccgccccatatgtgactagcagccctcctgtgtatttcatcgcgcccccgttgtttatatcagctattccactcaccacccttctgggcaaccctttatctcccgctctgaaatcccatcgctgagggctgggacccctcctcagtgcttatccctgtttccccgcgcgagtctggcgcctggcgtgtggaaggcgctcagtaaacgtttgtggagcgaagaaacgacgcaaaggtgatgagcacgacgcagttaggaggctattggcccggcgcgggggaaaagggggaaggtcgggctcggggtggcaggaccccagagggcaggggtgactgccggggtgctcttggggcaaggtgggcgtcaaggcccccagcaaggttgggataaagtttctctccgaggcacagactgccgcctgcgggctcagcatttacctctcccttcctccttcctaacgcaacttcagcggagggctgagggctctactgcgcattacctggaaaacttatttcactccacggccctaagaggtgggccttattattagccacggccagggttagggtgaggccactcctccagggcagaatttcagggggtgcccacccccccgccctaaatcattcagcaatcaacataaattatagttcaacgcaatatatcttatcttgtgggccgcaagccacccaggtgcccaggcaagagcctgaaggcacaagctgttccagtacagcaaagaaaataattagaataagaaaagttttactagagataggaaacggataggattatatctgaccattattaatcattagtttgtagcatcactctttgttctattaccataatgatctctgttctattatgattaccttgggggaaaccaggccacacagagttaggagctgaagggccacagtgagaggtgaccagaagacgagagtgtgagccctcattcacgcccagagaagggccgctggagggctccttggcctagcggtaatgccagtgcctgggaaggccctggttacttagcaggccttggtctagcggtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtgcacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtcctgcggccgagtgtttccctcgcttcacgccaacacaatctccgccgccctgtcttgtcatccccattctacagcccagcacggtgtagtatggcagccgctagccacaggtatccagggagccctggaaatgtggtcagttctaatggagctgtgctgtaagtgtgaaatacacatgggattttgacggcagtgggagcaaaattctcccaattctttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttggtcaggctggtctccaactcccgacctccggtgatctgcccagctgccgcctcccaaagtgttgcttgcgattacaggcttgagccaccgctcaccctggcttttttttttttttttttttttttttttttcagacaaactctcgctctgtcgcccaggctggagtgcagtggcgcgatctcggctcactgcagcctctacctcccgggttccagcgattctcctgcctcagcctcctgggtagctgggattacaggcgcaggccaccacgcccggctaatttttgtatttttagggggtttcgccatgtcggccaggctggtctcgagctcctgacctcaggcgatccgcccgcctcggcctcccaaagcgctgggattacaggcgtaagccaccgcgccgggctctttcattctgtctttattttctgagatagagtctcgctcggacgctcaggttggactgcaacggcgtgatctcggctcgctgaaacttccgcctcccgggttcaagcgattctcctgtctcagcctcccgagtagctgggattattgacgggcagcaccacgcccggctactttttgtggtttttgtatgttctgtcttctgctctttagtaccgcatagagccgcagaagactagcgagtcgaacaaacggcccctcttgcagcagttgttgatcacggggctgccccccggtactcatcctgtgtctctcgtccaaatccccgctcctcctcagctatcacctctgccgatgctggtggtttccctgggtaccgggaaccaaactctcattccccaggggcctaagccccccgtggccaggcccttctcaagtcagggttcctgcacattcacagttacgggtggccctgggagtaacacctggcacccaaacaggtcaccagagtccacacatagtccacctgccctccctgcgtaagataagctcttcctcctcccgacgatagatcagggtcaatgatccctgccaagatggcgactgctccagcctgctggtccaacctgtccagccacagctgttgctcgaaggcttgaagttcaatgggaccctctcccgctttctacaaactggttcctttatttttatgtttatttatttgggacggggtctggctctgtcacccaggctggagtgcagtggtgcaatcactgctcactgcagcatccacctcccagcgtccacccatcctcctggcctcagcctccggaacagctggggtacaggtacgtccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggattcggcctttggctacatcagtgtaatgtctgttcttgtagtttctctgacatgcccggcctcccgagggatgtcgccgagcactcgctggatattcgggccggagcccgacccgacctggatcctctgcgccgattcgacgaggagaagcgcagagcgatagcgcgaggagatccaccagctaatggcagccgggttcatcaaagaggtattccatccgcgaatggcttgccaaccctgtgcttgtgatagagaaacgggggaaatggtggatgtgtgtagactacactggtctcaacaaagcatgtccgaaggttccctaccctctgcctcacagcgagctaatcgtggattccactgctgggtgcgagaccctggctttcctcgacgcctactcggggtaccaccaaatcaggatgagagagtccgaccagctcgcgacttctttcatcacgcccttcggcatgtactgctatgtcaccatgccgctcggtttgaggaatgtgggcgcgacgtaccagcggtgcatgaaccatgtgttcggcgaacacatcggtcgcacagtcgaggcctacgtcgatgacatcgtagtcaagacgaggaaagctttcgacctcctctccgaccttgaagtgacattccgatgtctcaaggcgaaaggcgtcaagctcaatcccgagaagtgtgtcttcggggtgccccggggcctgctcttgggttcatcgtctccgagtggggcatcgaagccaacccggagaagatcgcagccatcaccagcatgggtccccatcaggactttaagggcgtacagagggtcatgggatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactcatgtggtggattctatctatcaccttgtcctcacgagtgggagataattgacaccaccctctttggtggtgagacctctactattgatcctctgcctaacaagcatacatcctggtatattaagcgtgtgactagctgactctcttccgtgcccacttgatgctgcaggattatactgtcttgtagtgtgtgtcttctgttgccgccaaggcctcaatacacaccctgccctgtgcttgtacatcttgcctctcctttcctcttgattatggtatctcgcactttcttctggctatccacaggagatgttggaaatgagcgacagtctcttctcgctgagctggacgagtgaagtatccatgtcatttagacgggggagtgagtaaaattctcccgactcgccgcttacgcgcactttcacccgaccatgaggtccctgtcttctactcagtccagaaggctcgaaggatcacttcggctcaatagcttcccaacctcaagacttgttcggaccccccaatcactttatcccaatgcgagttacttatcacagaaggtgatgagtgaggtatccgtatccctgatgcgtacgaatccctcttctccgtcagccttggctgc

SEQ ID NO: 671 - DNA, 182249 bp, Homo sapiens
aaactattgtcagtgctattactttacagacaactttgtcttgctttttatgtctcaccagctacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttggtaagtttttgcccctcacttctctctatcaagggagcaaacaatatggagaagctatttgttacactgatataatatttatacattttttctgatgtttacttgctgaagttttagcttctgcttccttttccattccacttctttttgtctttttgagtgactaaggctttgttctgaaaagtaattttctctagtcttttgatctttcccccatagaaattgttgccttttgccctttctgttatttggtttgattcttctttagagtcacatgtgacaggaactttgctaaagatctacttgattggcatataatggctgagttcttctttaccccagtccacagactcacactcacaataaggctcattttatggagatcagaattgggaaatcagaaagaatgatgttttgtttcttttagtagaataagatcctctaattaaaaaaacaaaacagaacaaagaaatagaagatacctggtactcatggtattggggtataatatttactacattcaggaatggtgagcataggtgtctgtatttgtacaagaattatagaaagactaattactaatcagacctggtaaagtatctgatggtaagggatcaaaggaaatgtcctaagtacagtaagtacagggagtgagaacaagtaggatcaggctatatcgctgcaatttttagttaaaagagaaattggttttactggcttagaatttttgaagtgtttcaagtttgctagataaatgggtcatcttgctttggaaaaacactctagtgtttcataactatatactctccaagtgctgctttatataatgtccagtttttcaaattttatttttatagacagtaatactcccataaacctccctcaaaaagaagacaaatgtatcagggtcatacaggaaacagatggcacacccaaattagcttaagggattatatacaaagatatgactaggctgtaggagaattacaaggtacagtaacctctgaccagtagcatactggttgttaccatccctaggcctgaatgtataagggggaggagcagtttctgaaactgaaaaggagaaaatttctagagaaggccaacttgagaggagcgtaacttttggtagagggatacttccagaagaaggttatttccttctctgaaagaagccaggggaataaatacccggacatcactcactgtctgttctccttcttccctactgttggggcttcttcattgcctgaacctaactggcacagagcaaggagtctattgaggcgcttcatccaagtcagcttcccagtgcagaaagcaaggtgcaggagggcagagaggagatctaaagaggcaaatgaaaggggtacagcacacttaaattaagatttttgccaaaagttgaaaatatctttaataataagtcgttcttcctatagttttgagaaatactgatatgagcaaaagatggatgagacttcagtttttatttatttatttatttatttatttacttagagacagagtctcgctctattgcccaggctggggtgcagtggcatgattttggctaactgcaacctctgcctcctaggttcaagtgattcttgtgcctcagcctcctgaatagctgggactagaggtgcacgctgccatgaccagctagctaatttcggtatttttggtagagatgggagttttgccttgttggccaggctggtctcgaattcctggcctcaagtgatccacccatcttggcctcccaaaatgctgggatttatacgtgtgagacacagtacctggccgagacttcagttcagttttatattggtattttggaaaactccctattacatacttgctttacctgaggtttaagaatggaatgaaactgggaatgtatattagagaaaataaggtaaagtttctcagctttttaatgatcatgagcccttttgccatgttaggctgtaataatgctagagtgttaccagcatccttttaaggaatgtgtagaggtaagtaacacttagcctaagggtcctcagaatactgtttgaaaatttctgttttcaggaaaggcttactatagtgggtcttaattcctctaaggattctgatagcagccttagatagcaaatacttctaatttaaaggtattcaaaggacatttctcctgaatggtcgtctaattatacctttacatcttacaaatgaaataatcaaagcctagattttgatattcaaccaagagtttggttaaccatggacagtggcaaatccaggaataaagtcagaactgttttggtttttttgtttttgtttttgagacagagtcttgctctgtcacccaggctaaagtgtggtggtgtgatctcagctcagtgcaacctctgcctcccaagttcaagtgattctcctggctcagcctcctgagtagctgggattataggcgtgtgccgccacgcctggctaactttttatatttttagtagagacggggtttcactgtgttagccaggatggtctcgatttcctgacctcatgattcacctgccttggcctcccaaagtgctgggattacaggtgtgagccaccgtgcctggccaactcagaacttttaatttcctacctcagtactttgatggccatgaaagaaatggtcagttttcttcatcattctagatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcaggtatctaaaagcaatgagtcttatgaagaaatggttctcattccatagacaaggatagcttattttgcagtgccttttatgctattagattctacctagaactgttaagaatttatctcccagaagtacattacattacaatgcttccaatatattttttttcctagcatgattagtttttgttgagttggaacagtgtaaaggactcatccatattagaagcaatgattatttctaacatattcacaaaattaattaaattatataacttgtataaattaagggaaatgaatgagagaaaactcaacaatgtattgcagtggttttttgagtagcctctttgggagactttactgctgccagatcaatctttataaaatgccattttcatcaaagcattcctctctgaaaaacttttaaatctgggactacaagataagatccagtctgacttatttttccgtcagtcagccattgttattgagagcttgttatttgtaaggcgttgtgctctacatatggaaaataaggaagatgcaaatgtctgtcattctctagttcacaaacattcttctgtagccacaccagcttctttactatccttagtggtccttagaacagaatactgccttatgctggacctgttctgtatgtaagacctccataagaactgtctctttaaagaacctttctctgatccttatagcctgtatcacattaatctcttctgtcctttaaactcctaaagcacttagtaacataatggttttagcacatattacatgtatgtgtgtttacctaatttaccttaaatatatttattaaatacctcttaccatattaaatatatatttaatatatattaaatatatttccatataacataagtatatgtttcatatatttatattaaagtaggcaaacatatttggataattaaatatttttatataatttcatatatttttttgagacagagtcttgttctgttgcccaggctggagtgcaatggcacgatcttggctcactgcaacctccatctcctgggttcaagcgatcttcccaccttatcctcctgagtagctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagccctttatataattttaaaagtgtaggtaattaggtaaaattaggttaaaagtatatgtatatttacctgatatttaaatattacctaagtgtttaatgtggacatgtaagctctttaaagatagtgcttatgtattttatatctgtttcacatactccttatatatcccccacagaaatggtcacaaataggttccttaataagtatttttgaattcagccatgctatatattcattagtaagtgagttttcttttattatgaactacaaactttaacctttttttgagtagtgagcagttattcatttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacataaatatttgttaaatgacttctccaagcaatagctttgtctttatgttatcctgtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttatttctcagtccctgactcttcttccgtcactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacagccggattgcaaaatagttttttctgaaatttcaagaagtgaaaagtttgatcagaatttattatgtcaaatggagagtttgtgtttattattaaaatatgccctatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatggattatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacataatctgatcagcatcatcagttaattagtatatgcaatgttagcctcaaaataaaaatgatgatttaagattcatggttgttgcagtgctgctcattttggttatttttaatgccttaatactttcggtaaaatacttccagggactaattaatgttttccttttttcctctttgacagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatctatgtagttaattaaagttaaagtttctgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatggagatttccttttaccttttttaatggggtaaattttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatatagctagaataatttttttcctttcttttatggacctaaatctgccaattgggaattttgtgcatgaaatatgaagttactttttatagataatcagtgcttttaagtccctaaaaggctcctgctgaagtaatgatgatgttcataataaaagcctttgaaaggctgaaaacctacatagtggtaccatagtatttggagcttctataggagtggagaggggcagctcattgttgagagttgcatgctgcaacctaatggtcagcaatgaaagaaatacttgtagaatgttcacttcagtgtgaagttttgttatctagttaatttatatacatatatcctttgtagatacatttctatctaatcttgttgagctaattaagaaataaggggtggggtaattgtcaacaaagggagaagaaagtggtttaagatcagggcagcagaaaaattagagaacaagaatatcataatatggctcctggttttctttataagaggcagtgggaagatctgactagatgaaatgtatcatcaaccaaactggcatctaaaatagaatgggataaatactgtatggggttattggaggcatattaagaaaggacacctaatttattttgggaagaagtatgttaagagaagactttctagagaaggagaatggggcattctaggaagagtcaatggcatgtgcaaaggcatgaataaagacagtgaggcatgttttggaaatgtaacagcttgattcagcttagcccatagggtaagcatagacaacagaggagacttgaggaatgagaactagatgggtacactatcataaagggacttgtctatcatgctgaggagtttagaccatcttaatggtagtggccaaggatggcatcagatttatagtttcaagtgatcataatattggcataaaagatatattagggaggaagcctgaagtagggagatgaaaataaggagccatcaaaggcagaatgaaacttaggcagatttcaagtgattttcaaaaatgatgtgatcagaggtaccagataataactattacataacactttctttgttaggagcttatttctcacactgaccaaagcttttgaagtaagtactctttacaccactatataaataaaccttacaaaggattctgctttgaggcatgagagagttaagtcatttgcccaaagtcacagagttagaaagtaatagagctaagatttgaacctaggcagtttggctccagagtctgtgctcttacactatattaccaccaagaggtcaaataaataccaaagaatgtattttcgaatttaacaatgaggaacttaatcatacaggcagaagtaattccagagcaccggagacagaagccagattgccatatgggttaaagagtgtgtaaaccactaggaagtaaagacatagaactactctcacaagtgcttttctggttattgtgacgctgaacttcatggcttgttttaattaagacatcttacaagtgtcaaaatttggaaatatttggacactgtacactctggttatttaaatatctaacagtggttcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgtaccaaaaaaatttcatatcaaataatattttcctgtagtgcattcaaggatctggttccacagcaaaaaattgttttggtctcagttcctcaaaatcacatttaaggagcttgagatttatattttctacttaataagtcttacaaaagcaagttaagaaggaaaatggacaatcatttctgcacatgtagggtttaataaaacatgtataatgaaatatttcatattttaaatttccaccttattggtagctttcatgacaaagggctagggtgctggtggccatacaattaaggtttttggttagttagttagcagaactaaatgactcctacctggtggctttttcttttgtttgtttgtttggttggttggttttttcccagatggctcaggaggaaggtaaatagcagtcattgtatgtgtgacagagtttgagatagaatgagcatattgaatcccacatcctgttcttattactgtcaggcagcgttgacctagcagtataaaactatctgaagcaatgtagtcactcagttctcataaagtttatttcaagtactgtaacaattcatgtttggattagaaaagtcactagaaatttgacttccatatagtaatctatacttttttctctcatttccttcactttttgagccgtaagtgtaaggcattttggtggtattattacaatggttatgaggagtttctttgcttgcccaaggtcacatagctagcaagttaaagtagattcaaatccaggcctgctagataccaaattattatttaagagtacttttcactactcctaaataatgacacagatatgtttgtcttacacatttcactttattgtcaagttattagtatgtttattttcaaaaggtattttttgcaatttctttttattattccgtactttttaaatttacttcattatcacgtcttcctttattctttttaaatagtttttgcttttgttattttgttttcccttttttactcttggtttgtaatacatctttccttatttgctcctttctcatttgatctcaatgttaatccaactgttttccacatctgattcactaaaattttagccctttaaaaaaaaattcctgtttttcctatctccttttgcccattctcttctccttgcctcacttcttttatctttttccattttactttcattttttgtttctctagatgttgttttgacatatgagttaatgtactggtacaattttgcatctgtaaattagagcttcagaatcaactgagtgtatttattctttatttttaggcctcaatttatcttaccttttattgattttataatatactatactctttcattttagtctgcatatgttagccaaagaagatatgcccctgttttaagaaatctctgtaaaaaatgtcaagtgtgacaagaattcttcaagaaacaagctcctctagtttgtcttctatatttagagcttcaacagttacctatattactggtaactcccaaatataccttcaaacttgttttttgggcccaagttttttgcttcatatatatctgttttgaatatcccataaataattgcatctaaagcatacctccactccattgttctcaaagataaaaccaaacctgtgctgcttcttatatttctagtatttaagcgtcacctgccacccctttacctgagctacaagtcacgcattgcattagactcctctgctttcttctttcacctctaactagactattcaccaaaaatttttaaatatataactttcaaaaggtattttattacatcatttccatcctttatgtttgggttcaagccctcattaactttaacatggattcttggagtaccctccttactgattttgttacacgtgtccctcttttagtcagtactaccatgataataccatggataataattttttcatttttatttttagtcttgctctgtcgcccaggctagagtgcagtggcgcgatctcagctcactgcaacctccacctcccgggttcaagtgattctcctgcctcagcctactgagtagctgggattacaggcacctgccacagctcctggctaatttttgtatttttagtagagatggagtttcaccgtcttgaactcctgacctcatgatccaccctcctcggcctcccaaagtgctgggattacaggcatgggccactgcgcccggccaataatttttcttttttttgtgctaatcatactacattttctttagaataaaagatcacatacttcagtttgccattcgcagtctggccccattgtgccattctagacttacctcctgccactccccaccagctttgttttgtcttagtcacacaaaataatctagcgtctctaaccagtcaaacattttaccttgtgccttggctcactctgtgccttttctccagaatatctttctgtgtacttttctcccatccttttacctttaaacctgctgctatggtttggatgttgtttggcccctccaaaactcacgttgtagttcaattgccaatgtaatagtgttgggagatgctacttttaagaggtaattaggttgctaagatggattaacatctttctcttgacactgagactgggttttcctgggaatggttagttcccaagagagtgagttgttataaaacagtgctgcctcttctattttgcgctttttgtttgcacaaactcggtccccttctgtttctctacgatgttttgatgcagcatgaggcagtcatgagaacccaccagatacagctgcctgatcctgaatttcccagccaacagaaccaagtgctaaataaaactctttttaataagttacccactctcaggtattctattatcgcaacagaaaacagtttaagacacctgctaggctcctaaccttgaggggctagaaaacaaagccagaggtccagtaccagcctcctcagagttagaatacacagctcatgagtgctgagctcagccttggcccctacaatcttccagaaatgaggccacttggctgagcccattatatgcaacattcagacccccaagggcatcaaagaagacaaaagcagaaaaacctatccaagaaacagcaacttcaaaggttgaagcaacatcagaccacacaggtgagaaccagcacaagaactccggcaactcagaaagccagagtgccttcttaccttcaagcaactgcgctatttccccaacagtggttcttaaccaggctgacatgacaaaaatagagttctgaatatggataaccttgaggaacatagatgcaaaaatcctcaacgactcaatttgctggactagcaaaccaagcccagcagcatgtcaaaaacgaatccaccacaatcaagcaagctttatccctgggatgcaagtttggttcaacatatgcaaatcaataaatgtgattcatcacataaacaactaaaaacaaaaaccacatggtcatctcaatagatgcagaaagggctttcaataaaattcaacatcccttcatgttaaaaaccctcagcaaactaggcattagaggaacatacttcaaaataagagccatctatgataagcccacagccaacatcataccgaatgggccaaatgctagaaatactccctgtgagaaccagaataagacaaagatgcccactctcaccaatcctattcaacatagtactgagagtcctagtcagagataacaggttagagaaagaaatataagacatccaaggaaaagaggaagtcaaactatctctgcagacaatatgattctgtagaaaaccccatagtctttgcctaaaagctctttgatctgataaacaattagcaaagtttcaggatacaaaattaatgtacaaaaattagtggcatttctatacaccaatagcattcaatctgagggtcaaaatcaagaatgcaatctcattcacaatagccacacacacacaaaaatacctagaaatatagataacgaggtgaaagatctctacaaaaagaattacaaaacactactcaaatcagagatgacacaaacaaatggaaaaagattccatgctcatggataggaagaattagtgttgttaaaatggctgtacttcgcaatgcagtttatggattcaatgctattgctatgaaactaccagtgacatacttcacagcattagaaaaaaaaacttttaaaattcatatggaactttaaaaagagcctgaatagccataacaatcttaagcaaaatgaacaaagctgaaggcattacactacccaatttcaactatactacaaggcttcggtaaccaaaacagcagggtactggtacaaaaacagacacatagaccaatggaacggaaaagagcccagaaataatgctgcacacctatgatctgatatttgaaaaaagttgacaaaaacaagcaatgagaaaaggactccctattcaataaatggtgctgaaataagtggctagccatatgcataagattgaaactggaccccttccttatgccatatacaaaaatcaactcatatgaagtaaagacttagatataaaacctaaaactataaaagccgtggaagatagcctgggaaatactattctggaataggacctggcaaagatttcataacaaagatgccaaaaacaattgcaactaaaacaaaaattgacaaatggaatctaattaaagagctttagcatagccaaaaacaaacaaacaaaacagtgaacacggtaaacagataacctacagaatgagagaaaatatttgcaaactatgcatcctagagaagtctaatatccagaatttataaggaactttataagcaaaaaacaacctcattaaaaagtgggcaaatgacacgaacagacatttttcaaaaagacatacatgtggccaagaagcatatgaaaaaatgttccacatcactaataattagagaaatgcaaatctaaaccacaatgagataccatctcataccaatcagaacggctattaaaaagtcaaaaagcaatagatgccggcgtggttgcagagaaaatggaacacttatatagtgctaatgggaatgtaaattcgttcagccgttgtgcaaagcactttggtgatttctcaaagaaccggcaacaattaccactcgacccagcgatcccattattggatatatacctaaaggaatacagattgttctgccataaagacacatgcacgcatatgttcatcgcagcactattcacgatagcaaagacatggaatcaacctaaatgcccatcagtggtagtctggataaagaaaatgtggtacacgtacaccgtggaatatacacagccataaaaaaataagattatgttctttgcagcaacatggatggagctggaggcaattatcccaagctaaattatgtaggaacagaaaaccaaataccgcatattctcacttacaagcgggagctaaacattgagtacacatgtacacaagggaacaacagacaccaagacctacttaacggtagagggtgggaggagggagaggacagaaaaactacctattgggtactgtgcttattaccaggtaacaaaataatctgtacaccaaaaccttaaagaaaagtgttttaaaaatgtaaaataaagcatatagcaaaacaaacaagacacctggtaaagttctgctcttccttcaaagacccagctcaaatgtctctttcataaagcctctctgacattctcataccccccttctctctgacctgggagaagctgtgttttcattctcccacaataacttgttcatatttctattataaaacctacaaatttaaactagctgtcagtgcatacttgtttgtctccttggctatgtgccttatgagatgcctgggatagagatcaattattattcaatttgaatccttggcattgggtgcggtggctgacacattggaggtgggcaacaaatattcgtggtataagttcactgaattacagagatgtatgcataagttttttggaactgggtttcatgaatcataggtacacacaatttgaataaaagaagaaaacaaagtggggcaaaagggtgtaggtctagtaatgaaatgggaaaagaaaggcacattgaaaagtcgcaacaaaagagagaaccagtacaattatatcaacatatagtaaacacattggagaagggaaaacaatacagcaagtgaaattgattctttggtggcagaaacaattgaaaggtatggaggcaaagaaggaggagaaattaaggcatagagataaattagacttggggagaaagcacagaagtcaaatatagcaacagatcttggactgggaatgtttccaattgaccattatgcttacgattacttttatgttgtggagacaatatttaatgagcatttcagatctgttaactaattttttgaaaaagtgactccagttcagtgataaataccttgaccaatatgccatataaagtaagaaatattttaccatacccaagaaactggttttaccggcttagttttgaccaactgatggcaatttgtacctgctaaactcccaattttttacttgctggttgtgtaggtaggcagtgaggtttgttggactgggcatgcagggacaagcagttaggccaatacatggactgaagattatatctatttatctgccttttgtttagctatttgcataaatatacagagtgggtttatttgcacacttagagctttagaataaaagaactttgactttcaaattggtttttcttgattttttaaaatttttatactccactttttcttccgtctttctcaaactcatttttccctagtagcagagttgagacttaatattacaaaactctgcttgctttaaagaatctaagaagaagaagaagaagaagaaaagacactaaagaacttccaagcagaagtttaagaagttctgctatagcccatccactcgtttgtggaatttaaatatatccgtttttgccacaataacagcgtagccttgctagaatcatatacaaagcagcagatttctttctataaattactggacactgtggtgtaatgtagacattgctgaggagggatgtaactgcaacagaaacaagttacttacattgcatgcagtagggaagtgggtgaaaagagcattgaactctgagtcgggagacgacttcaaggcccagctcagcactctagcagaactttaggtaagttttttagacactatgtacttcagtttccccatgtgaaaatgagaataacgtctgttctgcctacttcacttgaactatttgaggataaaagaaggtaaaatgcaataatggtcatgaagattttataaaccttgaagtgatgtacaagtataccatactgtttcacttttattactattataactgtttaaaaaagcatttgtgaccagtacaatcctggcttttctctggagactaacatccagtttcatagttattttacttttgatagggaaaagggaattattcctgttatatattgcaatatttaggatcctctagcaatttctcaggctaagacttcatgttcccagaagagggcagcaaaactccaaaggctctgccttttcctcaattaaaatgtctaaagcagtttttccttgagaggaaaagaactatactgtaaagaatagccctttaaaaatgatggtatttaggtgacaaagctaatcctattacaataaatataacattcattccaaataagatttttccttttctctgtcctgtgaagaaaataattgactgtttcttcaatctcatgttaattatttgacttatatttccagaaactcctacccatgtttttccatttaactctagatttgtagatcctacttagcaccagtttttaaataaattgtttcgtatgtgtaagagaaaaggtgttcaggcctgtttatagcttaggatgcctacctaagtccaaagagtgatcctcagcagtgtctaaatgtgttcctatcatagagtatatgtttgtcattcagataaaatgttgtctacatctaatctttctcattctttcattattcaaatatccccgtgcctttctatctttagtcagtgaattatcttgtaatgacaagagcaactaacatttgaactgttcttaactcacttaggccggaggttgcaatttttttttgtcaaaaaatcagaccttggtgataacttgagcagtaggctataagtaactagtaggctagcttactataagtaggctaggcatattaatagcgtataaggtgctctcacagacatgttttccctttgatactcaccatagccctgtgaagttgatagctactatcccccattttacagataaattttctaatctgtaatcaaaatagctgctctttgcttgaagaaaaagtccagagggacaccctatatgtcaagagagctccagggggtgggtaatttctttcataattgctagaagagccaattctgaatgtgaggctttttctatctgctttattacaaccagagatggaataggaaggctttcagttacagtttatcaattccttctgcttttgccagttaatctctagctttactcttttgaaaaaactacctgtttcccactccacttctgctaccaccactaccaagtcagagtcctctttctattccagccaaacctcttcctgttcttgagaattgcatcacattcttggcttaacgtaaccaacacccccacattggcaccagggagtgtgtagcccttctttattggctgaaagttcttgtctggtgagcatggaataagtcactcacttcctgaatttcagccctggctaaatttgcttctggaaaaacatatatatattcctcagatttttgtctgttggtttgcaaatctccttcactccagccctgtcctggaatgagcaagatttaccaaatagggacagcatgaaagggaatttagagggtagaggtagagggaaaaggaatagtatgtgtagcttgctgaatgagatgtctgctcttgctgtttccatttcttcacttctcaaacaatttttaacccaatctaaactggcatcagctcccattgtattgaaagggctttcactcaggacactaacgcccccccgccacctcccatattactaaatccagtggatacatcagccttgatcttacttggcatcagggtagcatgtgatgcttttggtcacatcctctttgatagattcactcttcctttgcactattattttttctctatcttagtcatgggtcttcagcatcctttgcaagctcctctttactcctaaagtactggtgttcctcagaaccctgttctatatcagcctcttttctctctaaacattttctgtgagaaatatcatccctttccatggcattattgagatccatctgccaattatttccaaatctctatcttccctgacctcttttgactgctttctagaacttcttcaattagaaattcctgaaagcctgttaaccaactccctccctcaaacctattcctccaataatgctcctcatccaaacatatgccacaccatctacccagtttttctaggcagaaatgtaggattcatccttaatgcctcttttgctcaccttccacattcagtcaataaccaaattcagtataatctacatatttgaatccatcagtttctccctgtccccactggcctaagtgatcaccatctatgtggcgttttgcacatccctttgctagtttcctgcccccaggttttctccccttggatcattttccactaaccactagatggttctttatgtaaatgcagttctgtaaattcaccacttgtgtttaaaatcctttagttgcttctcaccgtccttaggatggagtccgaacttcttatcacggttcataagcctctcatgatcagtaacttgccatcagtctgaactccactcacactgacctctagtgtttcaaacataccctgcttccttttgcctctaggccttcacagatgctgtttcctctgctcggagtgttctactgtagggcctctaacatctgtagactaaattctagcctcaaattatcagttatcttattcctgaatcagaactgaactgggattcttaatattttttttattaattcttgaattaaagccaggatttatattatcctatatatttctttgaaaaatgcaaagatattttctaatgaaactgtatttgaactaattaacttagggttcagtttttaaaaatcatagctgaatgtaaactggaacgtattttttttcatggtactggaatgttttcttggttgttattcatcatgacattctagctttggaatttttcatttccagctgacttctagcagtctcctttcttacctctcaaccccttacactctggttgccctatacttgcccctagatggatccagtttgcatgcagtggtagttgctgtgaggctgcggttaaatagagctgctcagactgcaacaggaaagcattgaatcgaaagcaaaggggaggaagcacaaaccgatacccaccacaaagctgctgagtgcccagcatgacccaagccgcaccctctgatgaggagtcttgtggaggagtaagaagccacagactttaataaaccatcagcacagcctgtcctccacttccctggtccagccttcccggatcaccatgagtatcaccgggtactgacctaagaagctgggtgatgacagaaaagtgaccagaaatgtagagtccagaggaaggtacccgaaatgaatgactgtagaccattttatctcaaactccctacacagtcaagcgtggtgagcacgaaggtccggggcatgagaatgtttctgaggagctccctgcttggggtgattcccagatgaagactcctaaaaatgttccctaaaaatgcctttgctacctccctgaaaggctgcttctagtagtggccaaaacaacttataaaaattttgtaactaaaaataaagcccttgcgagatacagttaagagaactttaaacatacactaaggtatgatgactatttttagattcctgacttcaatggagggaggagaaaggaaggagatggagcagcaaagacatatgttacctacttgattttgctcatggcctaccctgtttacatctgtcccttttgctatcaaaggagatattaaggaattataggaaagggaatgaaaagtgtggaaaaatatataggaactaagtacagattttaaacaccggtaaggtggagaactccttggaaatctagagcttcacagtggctctataattcacctgttcaggttcactacctcagaatctaagaaggtgagatctgggccctacttttgcagctggaaggtcagaacacaaagaatggaggtgactgactcagtctggaggaaaggttgcttggcttggctggaagtgggcacttgtgtcatcatagagtgccaacctcacacttcagataacagaacaggaaatattgttagttcagatgggagagcagaggactgactgtgtatccaagaccattaagttattcagtcacctctttgtgttgtactttctatcctacaagggaccagagctggctgtggggagcttgggcaatagatgaagcaggccatcaggccagtccctgttccttgcagctttcttctcccttctatcacgttcagcttctttaatctgctcaacccagaaagtcttccaagattgacatcattaccaaagtttaaatggaagaatctgaggcattttgataggagacaggggtgacaattctggagtagaggaactgtctctcacaaggcctctctactacaagtggtaaaaatttgtgctttattttaacaaccacaacaacagtgaattggaagggatctaataacagaacagaatttgtagtcagacaactttgttttgaaactattcttcctttcttcccttcctccctccctcccttccttctttccttccttcctttccttcggaaaggaaaggacagggaggatagccatagaatgggaagctccttagacctcagaggaatgccgcaagcttcccaagtctgagtgcctgcccagagtttgcctactttcttcagtagtcaaggatattcctcaagttgtgtttaatatctatgcatgagccaaactgtggtaggtgggtgactgcattccccaggtgcaatctttcagcatgtgacctgatgtagtacattacattccttagacaaggaaaaaatagcgatatgaatgcaaagagggggaggcagagagtgtaagctactctaaaacacttagttatgaaagaagaaagattggctagaaagcatgtgtaataaggaatgaattccatttttttaattgagagaggttcaggaatgtttatatacttgaggaaaaagcatagtgagagatcttaacaagtcacttcattcctaagctttgatacccccatccgaggtgaggaggagaggagaggagtttctataaagattaaaattgaattaaaatcatatgcacagtagtggcttatatgccacaaagccctttacacatgttaatttttataactattatcatctagtgactgtacagatgagtaagccctggtcacagctgttctatattttctaccctatatgacagagctgtcaagaggagacaggctcttgagtaggcagggctaagacacataaataagaggctaacattggtgtgatttgtatcttgacatgctttgagcttttggaggatggtgtgtgtatgtgtctgacttactagacacaatgagttaccatttatttcaacttgccctgtattcttattttaaaaatcttacttaaaacatggacacatgtcaaatccaacatgtctctaaaaagagctaatgtttggagaaaattttagaaatattcacaaactatgcatctgataaaggtctattcagaatctataaggaacttaaacaattcaacaagcaaaaaataaccccattaacaagcgggcaggccaggtgcagtggctcacacctgtaatcccagcactgtggaaggctaaggcaggcagactacttgaggtccggagttcaagaccagcctggccaagatggtgaaacctcccctactaaaaatacaaaaattagccaggtgtggtggtgcacacttgtaatcccagatactcgggaggttgaggcaggagaatcgcttgaactcggaaggtggagactacagtgagccgagatggtgccactgcgttccagcctgggcgacaaagtaagactccgtctcaaaaataaataaataaataaatagaatacatttaaaaagttggaaaaggacatgaacagatacttttcaaaagaagtcatacaaacagacaacaaacgtggaaaaatactcaacatcactaatcattagagaaatgcaaatcaaaaccacggtgagataccatctcacaccaatcagaatggctattattaaaaagtcaggccgggctcagtgcctcacacctgtaatcccagcactttgggaggccgaggaggatggatcacctaaggtcaggagtctgagaccaacttggccaacatggtggaaccctgtttctgctaaaaatacaaaaattagccgggtatggtggcacatgcctgtaatcccagctactcaggaggctgaggcaggagaatttcttgaacccgggtggcagaggttacattgagccaagatcgcaccattgcactcgagtctgggtgatagagcaagactctgtctcaaaaaaaaaaaaaaaaaaaaaaaatagtcaaaagccacagttgctggcgaggctaccaagaaaagggaatgcttatctattgtcggtgtgaatgtaaattagttcagctactgtggaaaagtagtttggtgatttctcaaagaacttaaaacaaaattaccgttcaacccagcaatcttcattactgagtatatatctaaaggaaaataaaccattctaccaaaaagacacatgcactcacatgttcatcacagcactattcacaatagcaaagacatggaatcaatctaggtgttcatcaacagtggattggattttttaaaatagggtatatacatagcatggtataatacacagtcaaaaaaatgagtgaaatcatatcctttgtagcaacatggatggagctagaggtcattatcctgagtgaattaaggcagaaacagaaaaccaaatgtgttagtaagatctcacaagtgggagttaagcattgggtactcatggacataaagatgacaacaataggtactggggactactagaggcaggaaggaggaagggggacaaagcttgaaatacttacctattggtcactatgctcattatctaggtgaggggatcattcacaccccaaacctcagtgttatgccatatacccatgtaacaaacctgcacatgtactcctgagtctaaaataaaagttaaaattattttttaaaataaataaataggtcgggcgtggtggctcacacctataatcccagcactttgggaggctgaggcgggtggatcacttgaggttaggagttcaagaccagcctgaccaacatggtgaaaccccatctctgaaaaatacaaaattaactgggcgtggtggcatgctcctgtaatcccagctacttgggaagctgaggcaggagaattgcttgaacccaggaggcagaggttgcagtgagctgagatcgagccattacactccagcctgggcaacgagagtgaaactccatctcaaaaaaaaaaaaaattaaaattaaaaaataaataaataaacaaaattaaaagttgccatgttgaaaaacactaatccatcttgagatgcaaggatctgtacaaataagactatatacatgaacttcaggttacataaaggagcagtttctgtttgtaggtggggggagtaaactttttgtgtttctttctggctcattgcaggatcacattataattttgctttgatacaaatttggcaacaggaatcataattctttttccaactgactacagtgcttgtatacttttaacgaataatcgctgtgagttgtacaaagccttatatattcaacaaatcagtgaagtttttatcctcttaatatttactttgtagctttgctttgaaccacctcagccccagttctacacagttggcagtaaagatatctgcaaattccactcccccatttcctttctgttttgcccttggtttttcaacagtgagatgattgtgccttcatttctgggtgcatcccttcacttattccttatttcccttctccatcccttactccttccttctcttccccaggccttcacaacctctagattttattactagcaacttcttaggccaatcccatagcatgctccttcatgcattacatgaacaaattttttgagggtgctgaaccaaacaatcaggtgtcttttttcaagagtgaacaagaagccactttttaaaaacagttttactgagatataatttgtattctataaaattcgcatttaaagtgtacaattcaatggttttcagtatatctatttagcagggcacccgtcaccataattaattttagaatattttcatcatctccaaaagaaaccttatattcattagcagtcactcatcaattctattctcccataccccacccctttattccctctagtcctagacaaacactaatctgctttctgtttctatggatttgcctattctggacattttatataaatgagatcatataatatgtggtcttttgtgactggcttccttcacttagcagaatgtttttgaggttcatctatattgtggcatctatctgtacctcattcctttttattgccaaataatatttcattgtatggatatttcacattttgtttatctgttcatcagttgatgacaaatgggttgtttctactttttggttattgtgaataaagtttctgtgaatatttgtgcacaagtttttgtatggaaatatgttttcattgcttttgggtagattcccaagataaaagaattgctgggtcatatggtaactctatttttagcatttagagggactgtcaaacttttccaatgtggctacaccattttactttcccactagcagtgtatgagctttccaatttctccacatccttaccaacaattattattttctgcctatattattatagccattccagtgggtgaaaattgatatctcattgtgcttttgatttatattttcctagtgacttttcatgtgcttatttgcatatttttctcttgaaaaatatcttgtaatcctttgcccattcccaacttagatcatttgtcatttcttattgatttgtgttttttatattctagtcccttaacagatagtataatttgcaaatatgctctctgattctgtggggctgttctttcacttgttggtgtcctttgaagcacagaagtttttcattttgattaagttcaacttatcaactttttttctcttttattatttgtgctcttgatgttgcatcaaagaaattactgcctaactcaaagtcacaaagatttactgcttaactcaggtcaaaagagttagttttcttctaaaagttttatatctcagcttcttttttttttttttttcattttttccatttttatttgatgtttccaaatataaaaaagtcaggattcttacatcaattatctcaaatgagaccatgcaaagcaattcagtgtatacaacaatcatttttccccttcagttctgctgctttatacaacagtgtgattgacagaaaattggatggcatgtgcctggtcagaaaatgtcatctgtttacaaaataacatcatgcagcacagtttctactttgtctgcaagtcaattcacaaaaactacttattttctgttttttatttgggaggcacatggaactgaaaaatttagctgcccaattttattcaactaccccaccaaaaaaaaaaaaaaaaaaaaatcacaaatgacagtcccaacactctgcaaattttggagggttgagatagtagacactatttgtcatactcagcagagttaactatttaacagaaataaatctccctagggcctttcctctcattttgctagactgggttccaggagaatcgtgaagaacccctcatgtaaaatttgaagtgtgaaaactgtgttgttgcattatgcagatttttgctagttgcatagactaaagacgttttgctaaatggcactgaaaatccttaccgagtgtcactattcagtccaagtgtttctgaccaaagaaaattatacaacaatatttataggctaactttaaagagatggttgacgttaatactgtacatattttacatgtcaaatacatagtccaagagtttataaaataaattcatgcatcattaccttattacctctaagaatatcatgtacaagatgggcactcccccacccccccagtacttatgacagcatttcaggtggaagcagtcttatatacaaaaacaatccagtttctctgctatgttaagtatataatttaaggaaatttcagagattactgaccaaaaaaatcttagtccattgaagatagaaagtgtcaatttgtgggatttaaaatgtttcctttataaaagaacacccagaatatgtaacctctgtacaaagaaaaaaatatacaaattctggatgatcatgtttgatcacactacgtacttgaaatgttgctggttaaaagttcttctgctttactcattcctttgacagcattaatttgtgaacatttatattcagttcagctgtatttatggcacaagatctcatttccaaaatggcactaattttccttaagtgtaacagcactctatttttagcagtaattatatttttaaaggttaatttgtagaacaaatgttttaactatactttttttctactctatactccccagttacaatatttacaaagggctgaagtctatataaaaaaatgatctttggctgggcatggtggctcatgcctgtaatcccagcactttgggaggtcgaggcaggaggatcacgaggttaggagtttgagaccagcctgaccaacatgaagaaaccctgcctctactaaaaatacaaaattagccaggcatggaggcaggctcctgtaatcccaactactcgggaggctgaggcaggagaatcgcttgaacccgggaggcggaggttgcggtgagttgagattgtgccattgcactccagcctgggtgacaaagcgagtctcaaaaaaaaaaaaagacatcttttactttcccccatccctcattttagtcaaacttctcccacctcatttctgccctggttggggaagtgcaagagtttcagataaggtacctatgtgttttagatgggattcttgattttaagtgagtataaagtaaaagatttaattcttagttcaggtatgttccagtgcctcgaaagttagttatgtgacaaatagtacctgttgacaacctagaaaagatgagacattctaaggtgccctaacaatcttcagtctctaacagctgaacaggaaggccatttcactcaactgtgatgcgatcatcactgactggcatttagaattagatttcaagactccactcctgtgggggccactaaataactgaatacattttaagagcaatctacactgagggaaataacggttctaaggtattctgcatagaaagagtatcgataatgggaactggcaactgagcatgctaaatcaaattccatgaatagagttttcataagatgtctttactacatgcattttgctaatatttccctaaaatattcaccaactctacagagttatactttgtgttaaggtactattgagttataagggaaatagccatatcaggtagctagtgacataataccagttgtgaaaattcagacaaaatgagtcgacaaatccccaaaaatggcaaattaagccctgtgacaaaataagttattggatcatacagaaatagcccaaatctggaaattttgaattaaaattgtaatcctgtaaaacaagttttggggtgaatggatttctttaataccaataatatttttaattcccaccacagatggatttgctgaatatgctaatgctgtgaatgagaaaacaattttggggtaggtatacccacaagtaatctgatgacaaaataaaccacagactgatgtcaaatggacaaaaaactgaaaatatgctgtgagaaatagacaaccaaaataatatagggggttgtggggtgtggcacagttaaggcatctaaacaaaaattccacatggctttggcttattaaaatattttacactatttttttaaaaaaagatttgaaagcatctgaaaaacatgcaaattgtttgaaaaccttgcatggcaaattcagacagtttgcaagcgtcaatcagatgtttgacgaggaaacgaaagaagcctctccccatgagactgcacatggtgggagaggcctacccagttctctctatcttacactagatggcaacccagaggtctgtgcagcggttacaaacaaggcattattatccgaagggaagggactgtagaatttccattggctggggaacaacccagctttagcttttccagatactctgcatgtacaggtttatgacactggagaactttgatagcatcttctactttgaaccactctctcttccttccaatattaacagaatcttcccaatcttctaatatttcagtgactgttagaacataaacatatgttctgtgctttcggtcttggttctgctcaaatatgcccagaagtctgcctagttttcctttgactccagcctcctcataaacttccctcacggcagcaccgccaggttcctcctcgggttccattcctcctcctgggacaatccactggtctgggtaccggctgctactcaccagcagcacctcgtcctcctgctcgctccggaagcacaggcacgccgcccgcttcttgaagccctcgcggtcgtaggtccgcgtctggttgggcttgaacttcatcatagaggcgggctcctgctgctgctgctgctgctccggccgccgccaccccgccggggagtgggggcgagggcgagtcgggcgcaggagcgcctgggagcgctagtcggtgcgggaggtgcggcgaggccggtcagtcccggggccggcggccgctccgacgcgggcgggacgggacgctagcgcgggtcactggaaccagggtgccgagatgaaagctccgcctctgcccagttgtccgccgctctccatggagcccgactcccgctcgcctccgctccctccggccgtagccgccaggggaagggcggctagaggcgcgcgccacgcggagacagttgcgaagacccgctcccactgagcagcagcaccacggcgactgtattttagcttctacatttaggcctatgattcactttgagttaattattgtgtacaatcttaggggtccaaattaattcttttgcgtgtggatatccagttgcccagcaccacttgttgaaaagaccattttttttttcccccattgaattgtcttggctctttcgttgaaaatcaattgattgtaactgttagggtttatttgtgattctcaattctgttccattgatctgtatgtttatccttctgtcagtaacacactgtctttgttactgtagttttgttgtaagttttgaaattgggaagtgtgaatccaccaactttgttcttcattgttttggcttttatgagtcccatgcatttccatatacattttaagagcagcagaaattgacaagttgattctaaaattcattaaaaaccctcacttctaagaaacaattaaaatattttctttccaacctaggatgaaattggataaggaggactgagcaggtacatttttgagttgtggtgatgggggatgggtcatttgaaagggggaccaacctgatggaggaggggaataaaggagccacaaagtttggtaaacttcccaccctggtgagaggaatgtttgttcagaggaggcagtttgttctaacaccagggaatattatgaaagataattgaaattgtaaagtccattgatatctccccagaagacaaaaaggtctctaagtaagcagtattgttagcttgttgattcttacagaagaagattttcatccaactaagggaagcagctgggactttctcagggctgtaagacagaaaaaaaatgaagaaatccctctgtatcttttcttacctctccctgtggccagccctaacttttgtccatttttgttacccttcccttttataagctccccaaaaagagagagaggagaaagagaaaaagaagaaaaccacagtgggagagagggttagagatcctggggatgggggaggaattctggagcatttcaaattaaagatccctaaggtactatgggtggaacctactaagtaatatgacaacttgtagcaagagtcataaggatgatcacatcttcaactcagtgatccaattcctgggaatttatgtaaggaaataagacaggcaaaaagtgtgagtgggaatgttaatgaaaatattacctataatagtgcaaacaggaacaacctaaatcaccaaaatagaagcatgttttatgacgtcatggcatgtaaagatggcagattataatactagcttcactgtcaaaatatactctgaattgcatcacttttcactgcattctgtatcactctggatcaagtcactattattcctcatctgaattattgcaatggcctcccaactggcatttctgctttcacccttgttccccacccccagtctactctcaacacagcacccttagcagtcctttaaaaacttaaatgtaaaattcatatggaatcataaaagggcctaaatagccaaagcaatcctaagcaaaaagaacaaatctggaggcatcacattacccaacttcaaattatactacaaggttatagtaatcgaaacagcatggtactgatataaaagtagatgcatagaccagtggaacagactagagaacctggaagtaaagccagatacttagaaccaactgatcttcaacaaagcatacaaaaacataaattgggaaaaggacaccctatttagtaaatggttctgtgaaaactggagagccactggatagaagaatgaaactggatccatctctctcaccacatacaaaaatcaccctaagatggaataaagacttaaatataagacctgaaaccataacaattctagaagaaaacataggaaaaattcttctggactttggcctaggcacaaaattatgactaagaccccaaaagcaaatgcaacaaaaatttaaacaaataaacggaacccgattaaactaaaaggcttttgtgcagcaaaatatataatcatcagagtaaagagaaaacccacagaatgggagaagatatttgcaagtatccatctaagaaaggactaatatccaggatctacaaggagctcaaacaaatcagcaggaaaaaaaaaaaacaaataattccattaaaaagtgggcaatttacatgaatagatgcttctcaaaagaaggtacacaaatggccaataaacatggaaaaaatttcaacatcactgaacatcagggaaatgcaaatcaaagccacagtgagataccactttaccccaaccagaatggccattgttaaaaatccaaaaagcgatagatgttgtcacagatggggtgaaaagggaacacttatacactgctagtgggaatgtaagttaatataacatctatggaaaacagtatgacgatttctcaaagaactaaaagtagcaatcccactgttgggtatctacccaaaggaaaataagtcattatatcagaaaggaaaataaatcattatatctgcacatgtatgtttatcgcagcacaattgacaatggcaaaggtatagaactaacctaagagctcatcaaccaattagtggataaagaaaatgtggtatatacatgccatggaatactactcagccacaaaaaagaatgaaataatgtcttgcactacttggatggagctggaggccattattttaagtgaaataactcaggaatggaaaaccaaatgccatatgttctcacttataagtgggagttaagttatgggtacacaaaggcttacaaagtggtataatggacatttgagattcagacaggggaaggttgggaggaaggtgagggataaaaaactgcatattgggtacaatgtatactacttgggtgacaggggtactaaaatatcagacttcaccactatacagttcatccatgtaaccaaacaccacttatacccttaaagttattgaaataaaaatgtatttaaaatttaaaaaagaaaacctaaatgtgtcatccactactcaaaagtttccatggctccttctcatttagtataaaagccaatgtctttgattagtcctgggccctacctcatctggcctccatctgtgacttcatctgatatttttcttcctgtaactccattctgaacatataggcctcctaactgtttcttgaatataacaggcctcctcctgccccagtgacttttgactcttccctctgcctcagagtctcttctcccagatatccattagtttgttccttcactgccttcagatctttgttcaaatgtaaccaatgatactttcttttcctgacaatcgtatttaaacttgctatcttcctcccatccctcagcctctagcatatcctgttcttccttgctttattcttccaacgcttatcattttacctgacttatttttctgggctgttgtctattcctccccctgtaacccatgctctatgagagcaaggatttatgtattttgctcactactatatcctcagtgtcttgactattcctggcacagagtagctgcttaataaataatttactgaatgagtgaatacatccacaaaaggagtgattatgaaaattgggtcataatttgaaaagtggaaagtacgttactgtaagctgtgatgtgcacagtggctgtggcaatgtggtgtagcatagtctgggagctgcagatgagagagatctggatttgaatcctgagtccactacttcctagttatgtgaacttcggcaagtgtacctaacctctcagttttatcatctgtggaacaggtagaataatacctccttcatagcatggtgaaaattaaatgagaagatgtaggaagaacctggcacataataggtgttctatgaacattaactctctctcttctcctaaagaatatatacacagtgggtaagaattgcaaaataattgggtgtttcaaagacagggatgatgcacttttataaaaaaattttaatacacaagtcctctctaagcatggatatatatataaaaacagtgccagactaggagtatggagacctgggttctgggttcacctctgatgcaggctgtgtgacattaagcaaatcctaacctcttgggactgtcttttcatctgcaaaatgaagaggtagaatttagtaagtttgagtcccatcaatgcttaaaattctataattcagaaaggcaggccattctacctagtttcatcccgctttagctcagccttactcagatatgctggccagatgtttctaatcttacacataaaagactctggtattcagaggccaaaagaaactggacaatttaagaaaagtactaagcagatgagttttccttctgtctgattcttaaacagctacatgacaattattcaaacttaagaaaacaggaaaagaaaagcaagtatgcacatttaggtttgaatcaactatgtgaatatttagccatgaagaaaaatgtgtttttttgtgtgtgttttattaattattatttgtacaacaaccaaaaagtagacgtcagcagttttcaactgtaactataaccttgtaccatgtggctgtgggccgaagtgcaggagggagtagctggaagggaatctggctagagccttcccctgctctggaaagctcgtggctttgtttttttcacattgctacaccgagacggaggaggggaggatgtttgggtttacaggccaccagccactgtcagcaagtttgtagccccagcttcacttccctgaaagggcgggggagtttcagctgccctggcctccctccagcaactgagccacagaggattcaaataccccatcagttgcaaggccctgactttacccagctgaaaactgactatctcatctgggaagggtcagttaaaaaatgacagaactgcctaaagtaaacaaagggaacaaccacaacagaaactttctctgcagtgtttccttataattaccggcccatcccaccagggctctggcttgagtccccatccactctccctgttgcccccacaggaccttgtttgagtaagccctagctgacctgaggatcgcctccctgtctacatgcctctgtcccaccctctccatggaggggagggagactcccgattgcaggaagttttgagaatggagtttgaggattgtcaggcaaaaagaccctctagagctcattcattaggacccctaatagatgagtaaacagcttaaatgaagtgcctaaagttgagagcaagtatgggacagaactggttttcttcttgctaaccgagtgctctttccagtaatcatatactgttgtaaggcactaaagataaggaaactaacattgaagttctttctccaccttttcattctaaccaaatcctactttgttggacttttacactttatagataggctgggcatggtagctcacacctgtaatcccagcactttgggaggtcgaggtaggtggatcataatgtcaggagttcaagaacagccttgccaatatggtgaaaccccatctctactaaaaataaaaacaaaaaaaaaattagctgggtgtggtggcgggcgcctgtaatcccagctactcaggaggctgaggcagagaattgcttgaacccggcaggcggatgttgcagtgagctgagatcatgccactgcactccagcctggctgacacagcgagactcaatctcaaaaaaaacaaaaacaaaaacagaaaaacacgctttatagataaacatattttgaatttagacttaaggacaaggactaaatcttacactctgtgtaccttgttcgtacttcagagttcatgaagtgtgttcatggtcagcagccaagtagagcgggtaggacatttgcttcagagttgagcaagcctcagaatcccatctctgcacattctagctgtgtaaacttgtaggcagattacctactctaaaacttagtttccacatttgcaaaaggggaacaataatagctccacctcattattttgtcatgaggatttcatggatgatacatgtaatgcacattgaaaaactcaacaaatgttagaaatggtaaatagttctggaaggcatttatcattcccattttacagatgagaaaattaaagctcagagagtttaagggctagagtcatacaattggttagtaagatagctaggatttagctcagcctcccagctccatatccacagtacttgctgccccaccattgagtgtagacaattgggggtggctctaagccatgggccaaatatgtctgtccctatcatcatggaatgacatgttatttattaagcccatatatgcttgaggtgccaggaaatggatgcttctggggtgaggtaggctcttcatgtgcagccttcatgtacagattccagccaaggaaaccaagcctggcactaatcccttgtccaagcccagagacgctgtgcccacggagtaggtcagaagtccttgaatatcctcagctttcctttcctctggcaatgcttccttgatgccctaagaatattttgcttaccctgacattagagccctcttcacactcccaagctttctagtattttgggtgtgcatctgattctcctgttgaaactggactccaaagtgaagtgctcaaaatggtacatagaggtatgagaaaaacatatgtgaatacttgcttctatttattttttaatctaaaatattaagaaaattaggctttactaatattaaaatgtcacagtagagtgtatggaatttatagcaaacatgcaattattaggcatgtatgctggttttcttttctttctttctttctttctttctttttttttttgatggagtggtatgaagaaaagagactagaggtaactgttctagaaagtaaggtcctacaggcagaagatgtgtctttttctaatgtgtattccacccctccctcattagcactaaatgactcctccctgattaaataaatttggcatctatgtaaacttggtggtctttcttgtttttcccctccttttgtcatccatctgatataatgtcttattcaatattctcccaagacctgaacaaataataaagctgtgttagtaaagagtgcaaattgccataaaaagactgaaaagtaagattcatagtccccaaggagatggttaatggtagtcaataaggcatatagcgggcaaaagaaaagctaaatgtaaaacttcatggaagaactcatggacacagtcaggcagggagccccagcactacagcctgagaaatcaaatgtaatctgagcatatgtgtgttttcaaactaaccactgccctctctctcctctgaaacttgcagaaagcaatgcaacacaatgcaatgagccagggtcttggagaaagaaagaaatcccaactctgtcactgtcctggttgggtgatcttgggcaaggtccataatcacccccactcccaggaaaaatagttcttcacctacaaatgaggttgagctaggtgattttggaggttactttcatgctttgaagcagcccatgttttcttcctgaggcaatttatacttcaagtgacaccatgaagctcactggaccaaaaatatcaccttaccaccaagcctttcatggtttgtgacatcctctcctcaggcaccgtgtctccatgcggtgcttcccaacctagcaataacttactggcatgaatccacttcaagtatcagttatgtccatgatgcatgtagagtgggaaagcaagatatgaaaggttatatatgtggtatgcgtatgtctataaatacctacaaatatatgtgcatacacatagaaaaagaactgaaagatactcagcatactttcaacactgattattcctagggagtaggaaagcaagatgaaggtatgaattttaccatttactttaaatcctcctatatttttgttgttttttaaaaataaatgattttactatttacaaataaaaattttaaaaaataaacattaaagtcctatacaaatgtttaataatatttgtaataagtagcaccagtttcttcaagaagccctaccagaagcaaatctgcatcttgatactgcattagagccttggctgaagtactaataatacccgaacattctatggaggattgggccctggactgggagaacctaatcacataatcagaaactcttattgagtaattttgggcaacttgagttttcccaaactttacttgagtttgtttttctcgactagaaaacaatgcttttgaactaaatcctctatcgggaactttctactctgaagtcctgtgattcttaacaacagtacatgcaaaagacacaggaaagtgagtatgtcatatggcatccaggatactttcccccaaagcaaagtgaaaactgatgtgaaactccttcttccttccttattttcctctctctctctctctccacctctgttatctaaatgctctatatttgaagcattcatcactttataggccttgatgggatacagaggacaaccttttactttagaagctgaaaatgtcagatacttgttttccagcttcccttacaggtatgcataggcataaggatctgcattgctttttgactcaggagctagtgacctcaaatagcaaagactgttgaatctgttctgcagcagggagtggcattagttgtaataacaacattcattttttagatgctacagtggtggtggttctggtggttctagcagcagggaccagcatccaggcttggggcattcactgagcagtggtttccatgcagtgggggcattgatgacttcatgatattgttctgcagtacaattttaggtgttgcttctggctatgtagcctctaaacctgggtttctagtcctcctggagagcttgtgaactacctaatattttttaataaattcatttaccgcttagattaactacaaattgtttctgttgcttgcgaccgaaaacatttactaatgtacctattatttttttaaaaaatcatgcacttggagattatatatatatacacacacatatgtttttaagggaaaaaaactccccttccctttgttgatcccttattttcccagtttcttctctggaggtagtaataatgatttgtttcttatgtattcctccagagatatcttgtgtgtacacaagcacatctatgtatttaagaaaagttacttaaaaatcactcaaataggatcactccatatacactgttccataatttgcttgtaaccttaagactacatgttagagataattccataaatataaagctgcctcattctttttcttatttttatttttagagacaggtcttgctctgtctcccacgctagagtgctgtggtgtgattatagctcactgcaacctctaactcctgagctcaggggatcctcctgcttcagcctcccaagtagttgggacaacaggtacgtgccaccactcctcgctaattttttattttttgtagagtcaggccttgccatgttgcccgggctggtctcgaactcctggcctcaactgatcttcccatcttggtctctcaaagtgctgggattacaagtgtgagtgactgtgcctggcctgcctcattctttttattggctgcttaatatccctctgaatgaatatactgtaatttatgtagccaatttcctcctgtaagcagttgggttgcttacagtttttgtgactacaaataatgctgcagtgaatatcgttgtaaatatgtatttttaaaaaaatatggaatgcttcatgcatgtcatccttgtgcaggggccatgacaatcttctctgtatccttccaattttagcatatgtgcagctgaagtgagcaagtaaatatgtcttaatgcccagtgcaagcagatacatgtctgatagggaagttgcagcgtcaaaaggtaaatgtaactttaacattttgatagatagcaccaaaatgcactgcaaatttagtaacaatttttaatcctactaaaaatattttagactcccccccaccaaatctttacgtcaccagtgtatattatcagattttataattttgctgttctaataggtgaaaactgattttctcattgttctgattttcattctttaatttatgagtgaggttgaacatttttcatgtatttaaaagccatttgtaagtattcacctgtgtagtatattcatgtcctttgcctgttgttttctattggatttttatctgtgtttaattgctttgtaaaaacttcatctttttttttttttttttttgaaataggttcttgctttgtcacccagactggagttgcagtctggcaccctcctgacttggcctttttttttttttttttttgagacaaagtctcactctgttgcctgggctggagtgcagtggcgcaatctcagctcacttcaaccttcgcctcccaggttcgagtgattctcctgcctcggtctcccaagtagctgggattacaggcatgtgctaccactcccggctaattgttttgtatttttcgtagagatggggtttcaccatgttggccagactggtcttgaactcctgacctcaagtgatctgcctgcctcggccccccacagcacccagccctgcctcagccttttaaagtgctaggatgacaagtgtgagccactacacctggtcaaaattccatattttaaagtaaatttgccttttgtcatacttgttgcaaaattttttcccaatttgtttttggttttctgatctttttaaatttgatctgatttttggtttttgctttgcataaatctttaattttcacaaagccaaatttgtctatatttttgcttatggctctggatttgtttggaatggcttttggctgggtagcttctcatggtttcaacattgaagctgctaatttagaaaaacaatacttgagacttctggttaaagacagcagattaaacacatgctccactccctcctagaactcaaccaaaatttaatgttttgattaagtgatacattcacatggttttaaaaccagaaaaatacaaagatgcacagcctgaaacgtttccctcatctatgtctcccatcagctcagtttccactttctccctgtccagaaataaggactgttatgctttcttatgcgtgtttccagagtttctttatgcatatgtaagcaagtaagaattttggtgagttttttttaaggagaaacctacaaggacaaaagaatataaaaaggacaagagtaagaaagataattttaaaagctggaacataaggccgggcacaatggctcacgcctataatcccagcactttgggaggctgaggcaggtggatcacttgaggtcaggagttcaagaccagcctggccaacatggtaaaaacccatctcaactaaaaaaacaaaaattagccgggcatggtggcgggtgcctgtagtctcagctacttgggaggctgaggcaggagaatcacttgaaccgggaaggtcgggggtgggggttgcagttagccgagattgcaccactgtactccagcctgggtgacagagtgagactgcgtctcaaaaaataaataaataaacaaataaaagctagaacatagatgaatgagtggtaactgaatcaagagacctgagaaagctgaatcctaagcctgcagatgagaaaggtaaagcaactcactttacatttcagaatcccccaaatgctcagcaattggtggcaccaggtacttttggaaataagggtgaagttgtggctaaaaacagtaagttgcattgaaaatcagttcaggaaacaatgaaagctccaggccccctcttcctcttgctgttagatggattgccccttccccacgatgtccaagaatggaggtttttctggtgggagagtaagacagagaagggacaaggcactattgtgtgaaaggacaacatgctgggaaaaaacaggagattataagcccattgccttctgccatcttctcttacttaggaaaccctgacagccagcctgaatattaggaaagccttctctgaaaccctgacacactggagagaaatgctccaaagataactcagaaatgacagcatctctgaaagaaaaagaaaacaagaagtattaataatatctccagagaaataagagaactagtgcatatatgaaataagaacagaatgctatgttttaaaaggaacattcagagaacaaaaaaaacttagaaatttaaatatgatagcaaaaatataaaaaagcttagtagatttggaaagtagaaaggaaagcagaaagataacagatagaaaataaaaaatatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaagaaaataaaaaatataagagcaaaattagtttatttgggagatgaccccagtaaacatctgtacgggagtaaagtaacgagaaaaggatcctacggaagttaatatatcttgcaagttactgtgaaccagtggaacttgactccatcggggaactctgggagacctgtgtagaaagcatgcttcagggttaaaccgcctcatggttgagcaagctgggatatttatctactaactctcatcagtcattggttaagggtctctcccagggaaaagggggttaattccccagcacttcctgagcaaactttcagtagctagaaaaagccctcaggcaaacagacatatgtgctggcagttttgaaggcctggatgttaagtgccaagagaatttgggcagggcactgatggcaaatgttatatcttccctgcactctctcttaggaaactactgaagaatgtgctccaccaaaacagtgttgtgagtcaagaaagaggaagaggcggaattcaggaaccagagcactcaacacagaggtgaagagagtccccaggatgtgggtaaagggaagtcccaagatgacagatgcacagcaggcctagaggtcagttagcccagagaggagcagatcagtaggctctggaagagctctcttccagatgaaactgatggaataccaagtttgtttggacatattgagaggagacttaaacaactacagaggagtatggattaaattagtggcatatgcatagaaaaactaggcaaatgaaaaatgagacaattattaactccagagaaagcaaaatagttttgaagaaagtgatcataatttattatgcaacacaggtgtgaatagtatttatttgatcatagtaatataaacactgagtgtcagtttaatagtgacgtagaaatataggcccatgtggtataggaagaggcgaaaactgaatccccatcttccacagtggaaagtcaatagagaaaactaagaggtagctatttagagatacaatgatttccctcctccccctaaaaaaagatttagtgaaagcattgaaagtgatttcctctgaggagtgggaaatgaaggggtggagtaggggaatgctgtttcttgtaattagtaatttagaaatatttgattctttaaactatgtgcatatttaactttgatgtttaaaaaaactaaataaaactcagtaatttttttcctttgctgtatgaaaaagggaggaggtgagatggaaaatgtacctcattcctagctgataagaaaactgggcaggcaaaatgaaacttgcttgttccatgagtccatcaacccagcagggtcaatgtcttttccatcttcttcagtcagaagaaaagctatgagcaactgggaaatcaaaactgaaattcctttgaaagagccattgatgccaaactgacctgaaatctggggctaccctaagagggctttggcctaaataaatggtccagggtaagtacaaagaaaggattctatcaaatgcaaaaatgagaccaggattatattaagggagctagtaacagcacttgagtgcaagtagaatacattcttaattatgtctaatatgaatttctttaaattctttaaaagccagttgttttaaaatacagaaattaaaaatattactatattgatttatagttttaattttaaaaaccatgggagtactttgtacagtcttttaattaaccgtatctatgactgaaattgcacatcgtttaggtctctggcccgatcatgataccagagtctgttactttctgattgcaggcaaaataactacaggaatgaggcctcctgaaggcagaatcagttctcctttctcttcctgccttcaatctttacctactagatccttctcctcagcctagaaaaatgcccaaaaagttccaatctaaaataaaaataaagaaggaattctcacttaagctatcacccaaactttctcttttccttcatcataatacttctaaaaaaatatgctaacttccttttcttcctttacttcctcaccacatactacttcttaactccttgtaatctagctttcactttgaccgttgcactgaacctgctgtctcagaggtctcaaaggacttcttacttgctaaatttcggtcctgcttagccctcatcctcctcaacctctctgtttttgactttcaaaatgtctcactgtgtctctctctgttgctctgtctctctctcttctctctgtctctctcacccacccaccctctagcccccttattctgtgttattcctctcttttggttttctctcctcccttattattcttcctttgagtcttctgtcccgctcattctcttaagaataggcatccaatgagatcccatgactccctgcaatatctgggatctgcctatgtctccaaactcatatgcaccctgttcccccttgttcatttcactccagtcacactgatgtttcagttcctctaatgggccaatgagctctttattaccttaggacctgctctctctacctgggacactcttccccatgttcccccacacccaaagcgcttcatctggctatttccaaatcaactttcaggtctcagcttcatattacttcctcagagtggctctccctaagtgcatcccctccccacccctccaaattaaatctgtttccccattttttctattttagaaatagtttttttatcaaattattatatggtttaaaatgaaagactacttgtgtgtttatttgcttaaatctctacctttctctccagagtgtaatttccatgaggacaggaaccatgtcagttttgtttaacactgtatccttagcattcaacacagaccttgaagcagcagacaacaaatattggttgaataaatgagtgaacaaagtgccaggcactacagtaagtacttcttcctgccaggcgctatggcaagtactttacatatatcacctcgtttttattcttaccacaaccctatgcataggtactactatcagatgaggaaatggaagcttacagagacagaccaatatgcccaaaatctcacagaaaaatgaatgtagctatcacgacgtgaaaagatgtagaggaaccttaactgcagattattaagttaaagaagctaatctaaaaagccttcatactgtatgattccaactatgtgacattctggaaacagcagaactatagagacagtagaaaggtcaatagttgctgggggttgtcctcgggagggatgaagaggcagagcacagaggattttaaggaacgaaaatactctgtatgatatataatagtggatacgtgtcatacatttgtccaaacccatagaatgcacgatgccaagagtgaatcctaattgacactacggacttggatggtgatgatgggttgatgtaggttcatcagctgtaaaaaatgtaccactctgtgtggggatgttgataatggagagggcctttgcatgtgtggggacagggagtatatgagaaatttctattctttctgctcaattttgctgtgaatctaaaactgctccaaaaaataaaatattttaaaaatgagtgtcagaggtaggatatgaaaacatttgtttgactctatgtagggcttaattataatattatactgcttcccagttgacaaatctaatactttcaccgtccaaaacttccctcacacttacttcctgttgtctgtttctatggtttctcttgagtcctccttccaggatccattccaagccagacaatggtatgtgggtgagaaactgtggtcatggaggagactggacagaccggaaagcttttcttttctaacacatgtttctgaggagccctcaggaagcctgtgaaccaggaaaaccacggtgatggtcaatgctctgacagctcccctgcccctttctccatgctcttctcctgccgtgccttccccaaggctgtgggttgctccccactgtgctgctccccttgggccttctctccctgcccacatatgcatgtgccagccctttcccctcacaaaaatgtcaacatagaatggtaagtagaaaaaaaataagatgcaatatcgtacaaatagttgttatgggttgaattgtgtcctcccaaaattgatatgttggagtcctaacccccgttacctcggaaggtgaccttatttggaaataaggttgttgtaggtataatcaatcaagttaagatgaggtcataatgaagtaggagggaacttaattcaaaatgactattatccttattaaaagaatgccatgtggagagacagacatgcaccaaggatactgccatgtggagaggaaggcagagattggggtgatgcagcagaagctgagaaacaccaaagacttccagaaaaacagcagaagacaggagagaggcctgggacatattctttctcacagtcctcactaagaaccaatttgccaacaccttgatctcagacttctaacctccagaaccgtgagacggcaaattgctgttacttaagccactcagttgtggtaccttgttatggaagtgctagcaagctcatagaaataacagaatcctgatcttgtaaagcaaaataaactcatgtattacgggttatcatcttgcatacgcacatacacatatacatagatgaacacatagaaacaatgaaaggcaatatattttaaaagttatcaatacttctttggggataatggatgctgagtaattttgctttgtacttttctctgcacctttgggtattttctcagttatcttacctctctacaatattatgcattattacctagaccagcggtccccaacctttttggtaccagggacctgttttgtggaagactattttttccacaggtggggcagcagtggggatggtttcaggatgaaactgttccactgcagatcatcaggcattagattctcataaggagcatgcatcctagatcccttccatgcacacttcacaatagggtttgtgctcctatgagaatctaatgcttccacagatctgaccaggaggtggagttcagggggtatatggcctggttcttaacaggccatggactagtacctgtccatgccccgggggttggggatctctgacacagacagatccccagacctcagtttcctcatctgtaatttgagaatagttataccaatcttccagcattgttgtgaggaataaagtgcctgacacaaataataggtcagtgggtcttcctagaatagggagagcagctccaaagaagtaaacctggacagacctctgtacctctattcatcatcaggcttcagtgttgctgctaagcaggcatgcggatgctgctcagcactggcctccctgtgtggtaagggtgggtgtgcagagatgagatggcacaggggagctagctggatgtcttgggtttgggaaggtcagcaaagaaaggtaagagagggtgaaagtttgattgaagaatgttggctatgtaaggacaacttaacccattggggtaacatttcttagtttgggttggggtccaatggggcaactgaaaaggaaaaaggaaccaagagaatagaaagcatagccaagaagcccaacaatcccctcctacaggaagaatgccttgcctcctcatttcttctctgaaacccctctggaaatgggagtggacaatgtaacttacttatcattttccacagcccatgggaaggtgttctttccccaggaggaatgtttcccaaacagccctccttctggccttatctgtgataagttgttcttttctggggactgtttgggtatccttgactctgacatactcagtagggcaggttaattctcttgaatcttaaatttagccatctgtgacttcatattaatctttggtctccaaaaacattgggctgttttgcctctttctactcacttatgtcttctttatcttaattccaaatcccagcaactcagagaagaattgggtcctgcaaatgatattcacaatctattgctttatgggaggtcagtgaaggcctttcccatttactttgttaaaatctatatctattttcattcctaattttttatctgcaagattatgtagcaacatgggaaacatttataatattaaatagtgaaagaaggggacacaaaaattgcatgtaaattatgattctatttgaaaaaaagactgagcaaatagacaatcaaaaagacatacacacatacgagaaaaataaaactggaagaaaacaaagcaaaaaatgaataatgactatggtaaagtgctggaattgtggattttttaaattcttctctatttacctaaaaattttaaggtaataagaaaatacttttataattaagaaacagacttactaaaataaagtaggggcagaaatgaggaacaaagtttgctaaaataaataaaacaggaaagcttgtagataaggttttatggaagtaaatatacgtagctcccagcttagtgtgtgtgagctgatggagaaacacgactacagagctcttatggaaagcatttaaccatttgtcacccttgcagtctacttcaagagtgactaaaaggaagaacaacatgaggaagacttcaaatgtgttgaggatttgagaagaggggctagaagtccaggcatgttagaggttttggggctgtagagagatactgtagaagttactaaattgggggttttatgggaagtgcttcaagcatgacattgtgaggctatgatactgtttatttttagaagtcctgttgagaggagtatctttcacctctcactaaattagctatgctccttggaaccatggacatctttctgctgtagcagcaataggatcaaagcacgtgtttagaaagagaagtgaaaaacaccagatgtgagcaaaaccacaaggggaatttcagacaggcagcatgcaccagatgacccaatttggaacgtggcccaggccccaggacaggcagaccctgtaaggatcaggctggacagtcagaggttattgatcccgatttaagccaaatgttgctaaaacttgatctgtgaccttgcttaagccattgacctcctctaaaccactttcaccatctgtaaaatgcaaggactgtgaatttcctctcaggaatagctaatggaaaccatgctaaaaagtagagataagaatgaagcacgatcttgcgatcttgaacaatggtggtaaattgtatttgattatataaataccacaacatacacacacttacagtgtatagatgcgcacactttatgagaagaatgtgtataaaaaacatagaattggccgggcgcgatggctcatgcctgtaatcccagcactttgggaggccgaggcaggtggatatcttgaggttaggagttccagatgagcctggccaacatggtgaaaccccgtctctcctgaaaacacaaaaattactggggcatccacctgtaattccagctacttgggaaactgaggcacaagaatcacttgaacccaggaggcggaggttgcagtgagctgagattgcaccactgcactccagcctgggcaacagagcaaaactccatctcgaaaaaacaaaacaaaaaaaccccatggattaaagattgtgttccatcaattcacagagtaaataatctatgtgttgacaattgaaggggtagaaaaaatattttttctcttacacatagctctttaagattcctagggccagattcagcatactgtctagcacagttagtgacaaatgaatgttagtatagaatagagattatgcttcaaatttcaactgtcttcaccacttagttgctatgtggctttgggtaaggcactctatcattttgtgccttggtttcctaatctgttaaatgggaaaaatactagtatctacctcatagacttgtgaagattacataaagtgatatatctaaagagcttagatgagtgctgggtggataatgttagttattactatcttctaaagtcttctatgtggacttcaaagctctctgcatttctttatttcatctctgttttctcatttaaatgtttcccacattcttgctccattcaagaatatttcttgtttgtcttattcatctatgtaggatattgctccctgtagactttaaaccagcttactcattccccctcaaagccattactgttttcctatttacgtcaattttgagtcagtctctaagttgaccctacaaccagaaatctatgaagcgtcactcaatcctctgttctcccactcctgggcttcttatataacaggatgtcctcttaaccacaggggatgtttcactaaaattaaaatgtatatctttattttctttaatagaagaagtaatcagttatggcatcacagtatataacagaaaatcagcttgggatcactgagcatggctgtctttaagaggatggggcagtgaaaggagtcctgggtgcagtgaaaatgccttctaccctttggagagatgttgacattggagagaaagagggatgcagtactgggtccaggaagggaagatgttggaattcatcctaggtctcatgtaccaaggaagtgactctgtatgagaacagaggggaaaatcaacaactgatcagtgataactatggtattttggccttagggctattaggggatgatgagggcaaaactgagaggaatgttagggaatcactttctctaaagtatcaatataaattgactctacttttggcactcacggaaacagcagaaagaggacatcacaacccctacctggacaacttctgatccagtttcaccaacaacagcgtcactcctttcgaagagcactcttgtcttccactgttaccttgtatgattatgtgattgttatcgtccttatcattatcactctcaaatcacttgaatttcttgcatccctccactatgttatcttctaaaataattttactacaagatgatttaatcccatggaaatttttgagcccctattatgaaggctaaatcctagggaatacaaagatgagtaaaagagtcattgctcttaaggagctcatatcacaagatttaggcagattgaaattgctaaccaacatttaacccaggtccaggtgctcctaattatcttccctattggtttgtcttgtcctgttcatttatttaacacatatttatttatttctttatttgagacggagtctcgctctgtcgcccaggctggagtgcagtggcgcgatctcggctcactgcaagcttcgcctcccctgggttcacgccattctcctgcctcagcctccccagtagctgggactacaggcacccgccaccatgcccagctaattttttgtatttttagtagagatggggtttcaccgcgttagccaagatggtctcaatctcctgacctcgtgtgaaagtgctgggactataggcgtgagccactgcgcccggccttaacacatatttattgagcacctactatgtgctaggcactgggctagcctaaggatgcaatagcaactaaaataagcatcatatttacttttagagaatataactgcaatgtgaagaattaggctcaatgatatacctggttgactacagaagaaatattaagtattcctgtctctcctccacagagtgggatgcactccagtgcactcctcttccaaccattacgtagtgaagttttagctgagacatatttagttcttatgtgagtccaacttgagaggcacctgacaataagaggacaaatctccactgtaatgctgaatagctggtagtctcatgtccagtattcctgtgcaaacacccttgcaggaaccaagtacccttcatattatgccctgattctatatgggttagacatacacatcaaataattttggtttgtcaataaacaatctaaataatagaaggtacagtcaattatataaagtttccaaagaaggataggggaagagtttccaagaaaagttttttcttattggaagaagcatatcagatgaaggcaagcattactttatgtatatatgtatgtatgtatgtattttaaggcagggtctggcactgtcactcaggccagagtgcagtggcatggatcttggctcactgcaacctcagtctgctgggctcaagtgatgctcccacctcagcctcccaagtagctgggactacaagcatgcaccaccacatccagctaatttctgtatttttttgtagagatgggggtcttaccatgttgcccaggatggtctcgaactcttggctcaactgatcctcctgcctcggcctcacatagttctgggattacagatgtgagccaccacacctggtggctcactaattttcactaatggcaataaaaccactacttacaatatcagagtgtacaactaatgtattagctgactaaataagggatgtagtaaatttagtcagggcttctgcctatatagagtaagaccccaaggcatggaagaatgactcactgtaataaactaagccaactaaatattgatgaatagtgctcacataacagcataatattagaacagaaaagaaaattatagattgtactggataactcattcaagcataaaatttggaatctgatggtcctaggttcaaattccaactcagcttcctctttgccacctctgtggccttgggcaacttgagtatttttaaatttgaatactacagatctatattcctagctagtagagttctttctcttatggattaaataaagtaatacaattgaagtcacatggtgcacagtgggcacttcataaatactctagtcttcttttcattgtacagaaaaggaacaaaagcctggaggactgatctaactttcctgaaggcccacagttaaccaatgtcagatccagatgaaagcccctggcttcctgactcctggtccagctggctgtctatgatttccaaaacagggctgtgccaaagacaactgaaaatacatttacctctgtttttttaaagctgaagagaatgaagtaaaaagagaggaggaggctgatgtggggtgagaggtataagaagcagatttactttcctggttttgcattaccttcctgagtttacactgcctgagcacacacccactaacggtggggggaagtggcagagcgtagccaacatgggattaaaaattgtgttacatcaacccacaaagtaaataatctacctgcccacagttgaagagggtgtaacagggtattgtgttttttctcacacatagttctttgggtctgctagggtcattccagatctaattttccagaagatcctatatacgcctttccattggagttttgagcttgctaatgtgtggatttggcagacaaatgcaaattaaagaagatatatatgaaaaatcacttgtagcctaaacatgatttctgtgtgggactggtgctccacatggataaaaaagccatgggccagagacaggatgcttgactgcttccctgcactgctgttaacactcggggggacccaagaaaggagattaacttctctgggcatctattttgtcacctataaaataccatcaagtagtcatttgctatacattgaatgcaagacgtttgtcacattttatttttctgtatccttttaagagcttcatggggcagattgtactcccacattacaagtaaagaaataagggcttagagatattgtgacttgtccaacgtcatttagctggtaagtggtagaatctgacagaacctggatttgaacccagaatctgctttcaacctccaagctacactacttaatattgtgagggagggaaaggatgttaaccttcaaagtactttacatcagtttaaacaaatgttcaatacaatcatttattaggggtataattcctaggaggtgcctgtacttaagtcattttcagctcattgactttctcattcattgcctctcatctgacctgtgagcctcaaaccacagttatcctatttcatttcctttgtttttggtgtcagtactcctcccacattggctgatttcagggggagccggcaccacttctcttcaagtaggggagtgtaagtgtaggaagccactcatacacacacacataaatatgcgcgtgcacgcacacacacacacacacattcatattagtttgtgatacacatacgtggtttcagaaattgacaatttaagaatatgtcattattatgacagtgcatatatcatgtataaataattccccagaattggggttgggtgaaaaaaacgctgtgataaggtgatagaaagtgaagagacatgtactaaggagaatactaagagacttagaaccttctggcttcagcccccaccttgaattttaaaagaagttcatgaattttttcctgctcattcggtctcctgaaagatccttacccttggtaggaaatgagcttgatacaacccagtgttgtatcaactgatactgagctttcactctgttatctgtatctgcattccaggtagtggtggtcatcagactgtaaactttggaggctcagggtcacatctgtggaattctctcttctgtggtccggcatggcatacaattagcaaattggtgatgacaacgtttttcattccttctattgctttttatttggtttgttcaggagacagacacaaaatattttgagactcatttaattatagcccacaactgtcatggcattcaacaagtgcagttattcgttaaatatgtacttgttgaacatcatggtactattattgaacatcacaataatatttcattttttgcattaacccttaatggttacaaagtgcatctataattagtgtcacacctaggcttcctaagaatcctttgagaagggagaaaggaataaaagcattacctaccttatgaggatttgtgagaatcatacaataaaagacaaaagtgcttagcactggaagctgatgcagcgtaaacaatcatgaaatgttactactagcacagttattagcccatattactgatgatatacctcacttcctcaagtttgcacagtgaagtagtagaattcagctaagaatctgtttccagaccccaaatctgtcttaggaaactatcagttgagatcgcaattatggaaggcaaaaaaacagagccttaaagggagagcaaacatgacaggttttatggtgggtgagtaggcagaagtgtttagggaccttatgtgcattgtcaagtgctcaggggagagggtgaggcccaggctatgtaccacaggcagctgtacaattcatttttggttcctcaaatgttctatcttccctcagcaccttcacatagaatgtgttccttctcccctgtcttattctctgtcttcacctctcttcccaacacttcacccaacattcacgcttccaggctcaacccaaacatctcttcttccaggatgctctccctgagcccctgtctgcacctactgacaggcactcacagtactctgcatgcctcctttagagaacagttgtccaatatttgtcttcccagctaggaggtaagcactgagaagtctgcaactttcccttgcttgccggctgatgtctccccagcagcagtgtccagcacgtttgtcaagtgcggagcagctgctggccaccttaaagatggaaaggaacgagactgaaaaaagggtgggaagtcatgaaaacaaatttaaaatgctttactattttgccctagaaccactcggggtggtgctattgggaagagctaggcagtgagaaaacataaaggaggcaacggaaaggagcgagaaaaaagacacaagaaaggcatggagaagtcacttgatgcaaagagtagcagacataggtgctcatcctgaagaaggctgggccatggatgccaagccttccgcagacatatgaaaggttgctgagaattagccgtttctctttctttcaaacttccccttgtttatgtctgccgtcttttgtcagaaagagatgcaggggccctgctctctccagaagactaacccctgcagcagtccatggaatccagggctaagtctgctgaggggagagggagggagggaagagtttccaccaggatgacatatttctgactctgccctctgacaacaaagggtgccggtggtgggacttttggcaggaagcacccacctttgggggagtcagaatcatgttgcggggtgacagtgactgaggcggaccctggagccctggccgtcttccctgcgcggccctaggcagcggtgcctggatgatctcctgggcgcctcctccgaggttcaggcagggctgagggaggatgcgatgcccgagctccggcagggcccattttgtttatgttcccactccttcgccctgggaagccccgagttcccacactcactgaggcaggaaggtcaccacggacacctcatctgtctgggccgttgactaactacagataagcagcagctgccacatccatgttggggtcacctcccagtctgcccaccctggaaccaggggagaagcccccatccccgcccacttgcacatgatgcctccccagcaaggtcagctgctcctgaggccaggatggcgacatggggccacagaaaaacttgcttttgcgggagaagcaagacatgactaagggattgaaaggtcttagacatgactacccgagagcccaggcttatatttccaccttacctttttttttttttagatggagtttctctctgtcgcccaggctggagtgcagtggtgcgaactctgctcactgcaacctccgcctcccgggttcaagcaattctcctgactcagcctcccgagtagggattacaggcacgcacccccacgcccggctaatttttgtatttttagtggaaattgggttttaccatgttggcctggctgatctggaactcctgacctcaagtgattcgcccgcctcggcttcccaaagtgctgggattaaaggtgtgaaccagggcacccagcctaccttacatttgctgagcactttagagtttcacagcgctctactgcctgcatcttttcacatgactctgaccaccacccgtgaagatcgcagagcaggtgtttttgtgtccattttgcagatgagtaaacagccccaggatgttcgagacgcttgccaaattcacacagatagttagtggtaaaagtcatgttcacgggggctttgtgctaccccatgcaaacacaccacaccagctgaacaatcccaatttttatccctaaaagaggactctttctcccaggtttaacctgttttccacccaagcctgccgtgtagtgagaaacatagcagttttggagtttgaatctgattcctcttcttgttaaccaaatgatttagcagttgtgtatttgggacttgatttccctgaatatttgcttccacatgtataaaatgcagataatgctgcctaacttgaacggttgttgtaaggtttaagaataacaagaaacatctattctctgttttccataccctaagcttggttctaagcaccttatgttcattgacttattaaattctcacaacatgcctgtgtgatttcatgcatgctatcattatttcattgtacagttgaggaacaatggcagagaggtaaagaaacataccccaggttacacagagagcagatggcagagccaggattgcaacccagactacagagccgagtgcttaatctccaagctatattgactatgcaaattatgtttactgtccacaatcggcactcaatcaacagctattactaagaattggggaagggtttgtttgaattacaagaaaaatgatcagctaactacctgaactaattagatgaatcaatagtcctgtctactcaaaaatattttctatgtagtattctggtttctaatttcttcccactagattcatagctttagagcacgaagtcacccaagggacttttggcaatgtctagagacatttttggttgtcacaaatgtggggtgctactggcatctaatgggttaggccagggatactgctaaacatcctacacagaagagttcctcaaaaaagaattatctggcccgaaatgtcaatatgctgaagtttagaaactactttaaaattgagtatttagagttgagtcatgattacttaagttttgaagtgccctgctggatccaaatttgacacatatactaatttgtttattcaaattggacacatataccagtaaagtaatgccctgtttaatatctagtgatacattaacatggttccttatatgtgatcatttgtcattacttattgttgctgctgctattgttaccaagcaaagcagatgtgtgccctagaaatggtcaggctgatttggggtttgtggtagagttagaaaattgaagctgtttttctgttaaattacgttaccaacctccaaattgctgacatttcttccaatatattgaagtaggtcataaataaactcacagcaatgccatttcctttcagcatacaactctatgaatccctggtatctttcagtgcagtcagctcttgttttgtgtgttatgtacacaccaaacagatttttaaagtttaattttgttggccccttttgaaaactcctgtagctaatgacattttcaaaatgataaaagttttattttgtcaaacagaactttgaccaacagaacacccttggtacccgatgcacgtgtggcgcatctgtgatgcctggcagcatactgaactttcttactttgttggaaaacactgcgtgtcacatcatcaacactgattttcatatcatcatgcattagcttcaaagactgtgtttataatcctcaaaggagttgtatcagtcagttttagccaggttgtgatacagtaatggataatccccatatcctaataacaaaatagatttgtatttgttcatgttacatgtacaccgtaaattggccactgattacttcatgtcttttgcattcttaatctagactgaaggagctggccctatttgggatatggtagcatcatagcaagggaaatgagaaagatgaaaccacatgatgggtcttaatagtttctgctcagcatatatgacatatgtttgccttctattggtcaatgcaagtccatggccaaattccttccataggccccataggcaggggcagcaaatattttaaacaataagataatctgctataagagtctgtttttgccaccaaagtcacaaacttctaaagagccagggactcagccttgaatcattgctttctaaagatgtttttatcaagaaatggggagagaatgtaaaatgaaaaagttgaagaagtaaaattatcagattctaatggttaatttgataaggagcagagttgggtggcaatgccaaggaaaagacagaaatgaaaaataatttctaagattccagcttgggtgactgataaatgatagtgtcaacaagtgaggtagagaagagagaagaaaaagaggtttagaaggagacaaaacaagtttcatttttgatgcaatgaatataaggtgtctttggaacatccgtgtagaaatatgcagtggacagctggatatacgagtgtggctcctgagagagtactaagctggaaacaaagctctgagatgcaagaccatgtaaataataataatcactattagggttgcatttattgactatttgctatgtgtcaggcactatgctaagaattttcatacaatttgcgtatgttgtattatttaattttcatgtaaccatctaagctgggtatatatatatatagtcgatgttatttatactcatttagctgatgagtttaaaagagggaagcttagggccgggcgcggtggcccacatctgtaatcccagcactctgggaggccgagtccggcggatcatgaggtcaggagattgagaccaacctggctaacacggtgaaaccctgtctctactaaaaatacaaaaagtagccgggcgtggtggcgggcacctgtagtcccagctactcgggaggctgagtcaggagaatggcatgaacttgggaggcggatgttgcagtgagccaagattgcgccactgcactccagcctgggtgacagagcgagactccatctcgaaaaaaaaaaaaaaaaaagagggaagcctaaaagttgatataatttagcctaggtctcacagctaggaagttgcaaaaaagatgcaagtgtttaatctgtgtaactgacattttagccaggtacagtctcagttggaaccatgacggcaaatgagaacatccagaaaccaaagatagaaagaaaagagaagagcagtgggccaagggcaggaccctaaggaatatgaacacttaaggagcaggaagaaaaagagcccttggagaagacagagaaggaacagctagagggagacttgaagagcacagtctcagaagccaagtgtgcagagagtgacaacgaaagggagggtctaacaaagtcagggataacagagtagctgaagagcagaccttggaaatgttccttggtgttgagagttaggtctgctccctgacagcatctctaatctcagggaagcatctgtaaccagcctattccccacccacaactcaggaataataataataaaaaaacacaggtggctagtcacacactgactttggaaacatcaacctgttgctggttcactctctgaactttgtttctcaagactgccttgaattttttacctgtctggatagatctttgtttctgggtcttagtgacctggctttcagtctctacctatgtacacttctctgaggttctggactgttctctcagcttaggaaacccagccttacaccacatccttatttttggttactacccactcccacctacagtcagtgaggttgggcactgaccctcaatccacagggctgtatctccagctgattctctgaaactcagcctccatacgggaaatgagttgtggtctcagctggtggttgctgtatctgttctgtagatgtagcaaatgtctgacaacagggctgctgccttcgagatcacaggttgctggtcagatttgccaagtcttgcactgcctgttgccagagcaagctgtctgtcttcaggtgggccttcccagttgccatgttattttttgtcacagctccagtagcttatggagatagaaggcttatatttggggaagaggatacttatgtaaatgggacttctcatgtcttctggatagtggcctggctatagtctggaagcccacactgtgtggacaccactgggactttctcatagccctgattgattggcaagagtccttgaaatctgtagagtaggcaactacagcatcagagtgggtaagtatccagacctgcctcactctcagagatttgaaccgaatgagccagtattatgaagaaaagcaaaaagcatctcctcgaaagtcctgcaagaagagtcccctctgatgtgagggcaccagaaacctgtagcatctctattatttttgtttagttggaggctgcacccacccatcagccttccctgaccatatccctcagtgagggttaccagacttagaagatgaaaatacaggatgcccagttaaatttgaacttcagataacaaatacatatttggtataagtatatgccacacaatatttgggatagatttatattaagacattattcaacatttatttgaaattcaaatttaattggtgttctgaattttatctggcctccctgtggccaccacaacacccataacttgagacttggtaggaattcataggccttgaaatccactggggccctatctctcccaagaaggcagtggagaactttgtgaggaagaaaagcagatgactgggcctctgctaggattactgggatcctaatactgtctggttccctctcctgggccagctcagaaggaccataaaattagatcttctgagtgcctagcaccttgtctgccttccatcgttgcatttggatgacagagagtttgcagagaacacaatgcctcttgacctatggcagcagcatgatcagtatcctgcaggactttcaaggggatgctttttgctcttcttggaaaatgtcctaatatatcctgaaacatccacatgcaacctgactagctatgcttcatacaatactctagccccaacagttctgagttacctgaaacatcagcaccttcaaaacagcacagaaatgtgtgacatttctgaaccaagttcagtgtagccagttatctgtgattctggagtgagagacaccctggtcactgaggttacctagacattttcaagagatgtctaacaccattttgtctttttctgtgcaactgccctagtaatgacctcctaaaatagagaaggaagtttcctgatgtgctgaggttgacactatgtttggcaagtcaagactcgctgcacctctgctccagtacagcacaagcaagcactgacgatgtgccaggcactgctgaaagggcttgcctatattaactaatttaatactcatgataaccctatgagctatatgctattattattgctgttttgcggatgaggaaactgaaacatggagtgataaagtaactcctataaagccatacaggtaaaaaatttactaagaatagaaatgaatgcaagcaactcagctccacagtgtgtcctctgcacctgcatgccagctctacacagctggaacctagcttcattcagcatcacactgttgagactggtgctgccaacactgtggagtgggccaccctgacccaggagaagctttatgccacacttcattatccctgcgtggaaaggggaagggcctgtggtcaagcatgttttcaagccctagagggtccaatgtgtgatagggacttcagtctgccatagcctgaaagctcagctcatgctatgcaaggcagctcaccttatctgtgcttgggtgctccatcagctgtgtgcccagcactcagaatcacagaccagattctctatcctgaaagcctgagtacaagaggtaacagagagactcgctctggaagactatggcttgagtatttcacaatcattctgctcaaatgatgtattttagacattgatgcatggtcttaatcctgatacagggcctcttggggcaatttggattgatgttaaatgccacgaagctcttcataggagcaaggcagtgctcatccctgctaggaaggccagaatgcagcctcagcacagccactggccctccctgaggtgatatggtctggtacactaccacaaaagcacctggacccaaagcaaagatacctcagggttcctctagagccgcggtgactccttctgatccacactcgcatctgaaactccagttttgggacttctatttgttgtctgcccacttcctggattgattgattgattgattgttatagagacagggtcttgctatgttgcccaggctgaactcaaactcatgggctcaggttatcctcccacctcagcctcccaagtcattgggaggtctgcccctcttgacctcttccctgactctgccctcttccctccctgcattgctcctccacccattccagtcatttataccctgataggtaaaagagggcttctactttcatggtctctcaaagcactgctttccaaccacagccctcagctgtgcctcagtttgggcctatcaggtctacatccacatacccaccacccctagacaggtgacaaaagtagtgcttaagaaacaaatgtgcttttttgcctcccccacacaactgactgctctggctaatatcactgctacacactttgctttcactaattattattgcctgccctccagaactgcttttttgcatacaaaggtttttgtccttagtgttttttttacacctcttcttggtattattattattgttttttatttttttatttttcgagacggagtctcgcactttggcccaggctggagtgcagtggcgcgatctcttgactcactgcaagctccgcctcccgggttcacgccattctcctgcctcagcctcccgagtagctgggactacaggcgcccgccaccatggctggctaattttttgtatttttagtagagacggggtttcactgtgttcgccaggatggtctcgatctcctgacctcatgatccgcccgcctcggcctcccaaagtgctgggattacaggcgtgagccaccgtgcctggccctcttcttggtattattgatattcctgcagctagacagtacccgggaaggaatgcaccaactagaaggagctttaatgagcctactgtgttatggctggcatcagccttcagagaggtttgagcataggatgccatctaattccccgccagcccattcattctatccaactaatgggaaaactagaggattgctgataataatagcatcagcaaaaatagttaccatttatcaagcatttactatgggccaagtactacgctaaatgctctgcatatattttctcacttaattctcaaaaaatgcaatgaggagaatgctattttatctctagctcacagctgagaaaactgacctgccaaaaaagccgcataatgaataagtgatagagcaaaattttgaacgcaagttaatttaaagcctgggcattcagccactctgctgccattatcatacatcatctgacttccttcatgtcccatctcccaacttctgttttttattttctcttttcctgattctccagttacccaccctagcagtggaggtgatatatatgaactgcatgccaaagtgggtgtagactcataatgacaacataatgacaccaactggaccatgggaaatggtgaaggcaagagtagttatttcaacttggccctttgaaacagagaccctgccgcaagttatgaggggtttaagtattttcctgtttcatttgcccttagatcccaaacacctagaactgtgcctagctcatagtaggagcccaagaaataccagcatggaaacctggaaagctggggtaaatctgatgaagagcacaggagccttagtaaatccgggtgatctgaaactggctcttagttgagccagatgataggatcttaatgacaattgtgcaccacttctcatttcttgcgactctttgcaggtttgcttcttgctgtcttattccaactaaaaaattctgtttacttttcatgtattttctctacctcagaattgttgcttattcataaattctgccttcttatcacatggttctgcttcctcatagttttggtttgctataatcctccatggctccactccattgtatgccatcctttcagcttcagctcccatggctaactgcttctttctatccatgtttcccaattcaaatcccagaaggagagaatctgattgatcaaacttaccttttccactcaagccctggtttttgggaaggcagcccctaatgtcaagggccaatcactggtccaatcaggagccatccctgggcaaagaacaacctacctctgcttctcaaagcagggggctctgggtggggcactttcatctcaaagaggaagttgggtgtggcaggcactgtgttgacatatccagtataggagtgccctgggagcccatctctcatttctgaaagagatagcattgtagatctggacgtttcatcacatattcccaggaaagcccagccaaatgcagctggtaagttgctgaatgtggaattcctcttggccttccaactccttgcactcttccttctgggactactttggtttttcagtttattacctgtttggagttggcttgtttctggactctctcttctgctcaggtgagcagacttctaactggaacgcctggctcttggacaaggtgagtgtttggatccaactttggttctgcaccattctttcaacttggatgacattgcctcacctcttgtatccttgtcctctcccttctactcaatccactctgctctgggttattatttacctgagggtgccttcccttcccagacccaccaacatactcctgagggaagaacattcaaaagcagctggtggcttcagtgagatcaatttttagaggaatgatcggggcagaagctagatagaagcaagttgaggaagtggaaatagtgagtgcaagacacttttctgagaagtttagatgaaaaggaggggaagaaaacagctatgtgtcaagagtttggtgtgtgtgtgtgtgttttattttttttgaaagaatttgcttcttattatataacacatgattttgtaaaacattttgaaaaaaacaaaaattataaacaatatgtttacaattgcccattaaactactacctaagtaattacaatagttaccaatttttgaatacctactaaacagaagaattatgctaggaacttcatgaattatttttctatttcttgtgcaatacaatgtcccagatgggtcagaattcagacagatatggctgtgatgcagaattagacaatgtctcttccctttaagcaatgattggcatccattgatttataagggggctgagaagtttgctgggggcaaaatggaaatatttgcctcagtagggtcttcagcattcatgggcatgtctggagacagttccagaggtaggcagagtgctggcaggaatggtggggcccctggagagagcaccgttggttgaggaaggagtttgtaacggtaagactgggctttagacctggaaggtcgtggtaagtctgactgtcacagggaagggcctaacccagcttccttgcatgtgtcttcccagaagaaaacaaagaagggcctctgagtcatggaaagagccatgaaactctttaatgctctagggcctatcgcccagtaactggtaactcagtgttatattaaggaagagagcttttcttttcccactttgaaagaggatgctgacagacatcacaggggctatcatagccctcaatttcccataaaaccggcaccacagtgccagctgtgattgcagaaaaaggtttttatccaagttgtgttaaggaaatagtagttgatttcagttaattcagtcataacactttaccttgagcattaatgctgaaaaagtcaactctcttacttcctgtttttcaaaagcattattggctagggtaactgtgcagggctccacgctgacaccgtttgtggacttttagctcacagtggtgctgtcagtgccagcatcttggtgtctggctaactataacaatacacatgatgacaacactggcttaagaacacaggtaagatctgtccaccaatgacacccaaatgtctttgtacaaaaacacctactcgatgaggccctccctgaccaccttatgtaaaaccgagcaacccctctgccttcctaccctctgcctaccccgactttctttccatagcacttatcatcatctcatgttttgtcatttttgtttctttttcttcttttttaatcatcgtttttcctgtcccaaaaagcaaatgccaagaaagcagtgtccaggtctgtctgtttattgttgtgtccccagagcccacatcagtgactcacacagagtgctcaatatttattgagttaatccatttcatgaatttctcataaatatttggggaaggataagaactatgaagatttttaattaacatgatcacatttggatttatggctcaggagaaccaaggatatttgcttacatttataccacccttacaaggtccatactctaatatggccactttgcaggtgaggaaactgaggatcagagtgaaagcaacctgcctcagcccccatagataataacgatcagagccaatataaactggtgtagtaagtaagaagacaaagtaggtagtattgctataggtaaagcaagagctaaggaaagccttagttgatatggcagaaataggaacagagagaaagggacagaaaaggaagaaactgtgaagcctgattagaaatatggaaggcagaattcaatatactcctagaagcagcccatgaaaataaaatgaagaaagaaggattgtttttctaagaggagggtggcttcaatttctttcagaaaagattggctaactgaaaactaagaaagaaacagaccaaatccttgtagcttctagcacatctatgataaaattctgttaattggatttcatacttggattataactgcacaacacatgagagtaaaatgccttaagacaaaaagagtaaaaattgagtcataatatggagacgatactattctggcaatagtattcaaagaatggaccagggagcagtgcacagctttgggaagcaggggttgtcaacattaggactcagagttgttagtgatgaggttcccaggcaacataagagacccttgaaaaaggctttggcttagggaaaaagaattataggggccagacgcggaggctcacacctgtaatcccagcactttaggaggccgaggtgggtggatcacctaaggtcaggagtccaggaccagcctgaccaatatggtgaaaccccgtctctactaaaaaatacaaaaattagctaggcatggtggtgtgtgcctgtagtcccagctactccggaggctgaatgacttgaacccgggaggcagaggttgcagtgagctgagattgggcgccactgcactgcagcctggggcaacagagtgagacttcgtctcaaaaaaaaaaaagaattataggacccaagtaagaaggtctggctcccttggcatttctcaccccctggcccattagctggtgttgcagactccactgtggtactccaaggggttttagagaaagaaccagggcagatgaccatccaaatcagaagggccaggtaggatggtcagccacacatgtgaggggcagatagggaaacagaagattaatgcatatgggaagccccaggaagctaaatccatcccagatcacactggatactggctctgttgaggcaggtggtggggggtcagcctggtgacagcatatttgttcattcaatcaatatttactgaatgctctttatattctaggcactgtgccagacattgggctaggtgctgggaattgaaataataaactatttcctgatttctcttctctcttctggagaaagaattggattagaacaaggtatggttctcactggcacagggattgggcaaggccgtctgcaagaggcagacatcagcttgggcaatggggtcaagttggggatggcaggccctggctgatacaatacttatattttacctgaaatctgtgtttattttctatcttgaacctggtattgtttatatttgataagcaaattttatgttttaagtaattcctagacatacagttaggacattttgcaggggagggcttttgatttttaatcctaaaagcattagtttgtctgtattgccgggcttgacaatcacataaaataagtgtatttcaaatcactcaataggagtggctgcaaataggggaaagaacatgatctattactactttggattactactttttactggcaaaccataaatcacagtggggaagccacagtggagtataaggaacttaaatcatggcaagagtgatttaaggtcagtcagtgcagcagataatctggagagatgatcccactcataaccctttaagacatgacacttggtaaactacctaactcataagggtgtcctggcagtgaacctccacacctcctggttggggtgtgtgctccatctcacccagcttaagtaggcctgaaagaccaccctgttctctcaggcaagagtattcctcttcattactggaagggaattaaagacaaagctggtctaatcaataaccgcaggcccttgtctcactgagaagaataaaaatgaatacgcaattatttgccattgtggaatgtgttttccctagtatcaatgctgtatgtaatactaagatttctacagcctatttaatatagaatatatacatacacgcacatgcaaacacatacacacagatatatatatatatatagttgcctcttgtatggtatccagtcaagtgtctttactgtaactggaaatcaaaattacatcaatagaaaaaaatgctacaccagtagaaaaggtgggggggggaataggagaatgaaaaaggggaggagcaaaaatgaaaattcacttttaaacaaatgtaactttggctatatggttacaggtataggttctggctgaaaagatttcaatgtctgctttaatgtaaattataagtattccagaagacagataattttattttactttttttttttttgagagggggtcttgctctggcccccaggttggagtgcaatggtgcgatctcggctcactgcaatctctgcctcccaggttcaagcaattctcctgtctcagcctcccgggtagctgggactacaggcacccgccaccacgcccgcctaacttttgtatttttactagagatgggatttcatcatactggtcaggctggtctcaaactcctgacctaaggtgattcacctgcctcagcctcccaaagtgctgggattataggtgtgacccactgcacctgggtgacaagataattttaggagccactttaaaaagtttccggaactgtagtctattatttcagtctcagtcccatacaccatgaaaaatttagggcatttcattgctacaaagaattttaaagcagaatcaatccatgtaattaaatcttaacatttattaagtgcttattgtatatcaggtacttttacttttctaatcattgtacagttattaattcattcaaatcttacaaaagtctatgagttattgtttccattttacagatgaggaaattgaggcacaaatattgcccaagatctcacagttagtgattgacagtaagattcacactcagaccatctgactctggaggccacacttgtcattcatgttaatcttacttaacatgcttcatgctaactacagacttagttatctccatatgcatctttcaagtagatggcttatcacaacagcaattagacctgtttacatgtttggcgcttatttattgaatgattacctactacacactgaaattggttaagtttgtttctaaaactgacaagctttgttttaaaaacaattcatcttcttccgctctttttttcacaagaggtagttgtttggatagtaaccttttgagaaccaaaagaagtgaaggagagctacttttgtgagaatgaaaggtggagggtcattcattcaagaacttgtttttaccaggtaccagttgtcagtatgcaaaagcagcgaggtatgccaatgtaattcatgttcaataaacatcataaaatttatttctatacattaaaatcttcctgtgtaacaaaatgcatgttttatttttatctgccacttttcttaagtcagtagacaattccctcttctttctcccaggcttgatatgaggttagcttttcacaattggtacttctgggggggcaaaaaacaggcaaaataagtgaatgggaaagcactcagacttattatttattaatttgtgatattctagcctttcagtgactcttttcatgctattttttccaacttctgtgggatggggaaaaaacttatccggagtgacaacatttctattttccattattatttcttgcataaaatattcaaaaacaattgttttggcatcatctcacttcgaagataaagaaagcaatagtaaatatcagcctgcatattgggaattcttctagagaatattatttagacttcatgaaacaaaagaggagctaaaattatgctttgtgtaaatctcagatagtggttttggcttaaaatttgctatcccagcactttgggaggctgaggtgggcagatcacgaggtcaggagatcgagcccatcctggctaacacggtgaaatcccgtctctactaaaagtacaaaaaaatgagctgggcgtggtggcgggcgccggtagtcccagctacttgggaggctgaggcaggagaatcgcttgaacccaggaggcggaggttgcagtgagccgagatcgggccattgcactccagcctggtgacagagtgagactccgtctcaaaaaaaaaaaaaaaaaaaaagaactttctgttgtgttaaagttaactagcgaggagactcttgattcctaagaaatattaaccttatatccccaaatatatttcatgtgcagttcaacaaatgaaagttaggtgctctgaataggttttggggttaatgagtctattagaatacaggctttttgtatagcagcctcggagagctagcccagccaggcccagtttctgctgtttctcaagcacaggaggctgagagtagagaaaagtgctctgtaagaaggctgagcccctcactggaggtggaactactaccctacatgttttgtttgtttagatgatacgctgagaaccaaatctaccctgtcagcttactcttcaagaacaagccaagcaactgaaactgagtccacgctcagctaagtcaaagcccaggggattactggcatcaccacccaccccacctggagcatgacaatgtctgtgagagaataagagatgggtggtgtcaccactatctttctctttctgttctccaaattataataataacagtctcttttcctcctctaaacattttttataaaggaggttgaactcagttgaaatatcttgaaattactgtggctggtttacaagccactctggaaagttatgctctggcataaatttagcagctatgttttactgtaaaaagaaacccagggacatagcttattaagaaaatgtggtcaaagtgagaattttctttggttttatgaataaatatagatattatattacaaaattagatttatatcgttgagcttgatactagacagtaaatattatttcttaggaaaaggttaatacatcattaaattttaaaagttgaacacaaaatctctaacaaattaaatttaaatatttccatttcaatatcattgcagacagttcatggtagtgaagtacattgagaaaacttgttctttaagaaaacaaacttctgggtaaaagatagtaatatatcagcaaaaaaagatttttatcaagagggttgaaggctatagcatcatcaaggtaaagatcaaatagcatggaggctaaaataaacctgtgcttttttgagcgggtggtcaatagaaattggctctgttgctggagatcctgaattttaaattctggtgatcaggccagtaatatgctgatgaagcagaaatgtcacagcatattttaccaagtcaaagacaggcaacagttatgagagggacatggagaacctggtagagctctgtgtactatgctgaattaataaatagagaactaacttaaggtggacaaaactgctgggtgtctctcaggcttctaatgttttcaaaatgtatttgaagacttaaagccttataataataagaagaagagtagtccaagttctgtttatttccttttaaaaggagtcaacacttgaggagacaattctgtactcccacaacaggaaaaatgcatccttttaccgtgtgaataattgaaccagagtcattgcccactcttcaggaaatagctcatgtaaacttttggccgacctgtgcttcacagtgcacttacctcttgacatccacctctgtaaacttttatttgtattaccaaatattgactgcaaacaaaaaaaaaaaaaaggaagaaaaaggaacctcccttatacaattacagaacgttagagcaaaagagaactgaaagatgatcttgtgcaggccaccattttatagatgaagaaacaaaagcacagagtgacttgctaatgcttcaccaagctggcacagcctggcctagagctacattcccctgtgtcccagacccacatgccagcaccaacatcatggatcctctctctctctctctcttgtgagacagagtctcactctgttgcccaggctggagtgtagtggtgcaatcttggcttactgcagtctctgcctcccgggttcaagagattctcccgcctcagcttcttcagtagctgggactacaggcatactgccaccatagccggctaatttttttgtatttttagtagagacgggatttcaccatgttggccaggctgaagatcctctctcttattgcttgatgaaaaaatgtattaggcactgggaggatagaaattaaagagccccaatacttgacatctaggagctcacaacccaataagaaaagtacacatgtagaccaccctccaatattttactgtactctgtacactgttgctagaatgatctttctgaaaatacaaattgtaatgtatctaaccctgtgtaaaaccgtgcagtggctccttgttgcctgtaaggtaaagctttccccttgttctccagccttctgtctaactgggtctatgctgatgctcaggatccagccatagagaaccaattgcttttccctaaatatagcaggcttttccctaaatatagcaggccctttcatcctgccaggcctttgttatgctgttctctgcctggaatgacctcctctcattaccctccaggagggttatctctcttgtaatagatttccttaggtttctctccttccacctccaaccccacagacagaattaaccattccttcctttgtttatttgtcctgcccatatttctcctacagcacctatagtgctttgtaacattgatttttttttttttttgagacagagtcttgctctgttgcccaggctggagtgcagtggcgtgatcttggctcactgcaagctccgcctcctgggttcacgccattctcctgcctcagcctcccgagtagctgggactacaggcgcccgccaccatgcccggctaattttttgtatttttttttttttttttttttgagacggagtctcgctgtcgcccaggctggagtgcagtggcgcaatctcggctcactgcaggctccaccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggccaattttttgtaattttagtggagacggggtttcaccgtgttagccaggatggtctcgatctcctgacctcgtgatccgcctgcctcagcctcccaaagtgctgggattacaggcatgagccaccgcgcccggccgattgttttaaaatacataaatgtacttgccatttacacttatgtctttctctactaattgaagataagctccttaagagccatctttgtaagggccatctttatctttgtacccctagaatctagctcagtgcctggctcagaacaactccattgaatgaaccatccatacaggcccttacatcatgctatgggaatgcaacagaaggagcagtgaactgtgcttagaggagttgccttggaagctgaagcatgtataccaaatagaggaacatcagggcagggcaagggttggttcatagctggtcgccagaatagaatgctcaaaggtacaggggcctgagaagtggtggaaaggttggcaggtttgggaaatttgaggatacctgagaggatggactgtgggatgtggtggtttgctgttattattcttattgttaaaccagaagaagaggctatgagttagtcaggggctgtgtgttaaaaggcctggcaattcatgctgagaaaggagttttgattatattacaaagagctaaagaaagaagagttttgaaggtcagtattcaagagtagggatgattggatatgcctgtcagagacaaaggacaatgcagtgaccaggagaggttgctccagggaggagtgggactgcatcttagagtctgggtggggcattggtgatctgagggttcagagaactgagaatggtccaggtgaaaactgatgagggcctgaggcaaggcagtggagatggagaaaatgagaatgattggagaaataaacacagcagtggtggaatggtgactggcaatcagctgaagatggggaataaagggaaatgaggagtcaaaaatgatcccaagtgtttatcttgaatgtttaagcagatggcgttgtcctgatatggaatgcagaaaaataacatcgagttgagtttgtgatgctttcgagatacttaaatgaaaatgttgagaaagcagttgaaattacatgtctcatattcaggaaagagttgagggcatgagtctctctaggtaataactgattccataggacaggatgagagcatctgagagcatgtgagggcgagagaaggtctagaatgaggccctcggttaaggaggagagagaggagaatgagacaacaaagaaatccaatgtggagtcatgagagccatagaaaaagagtttattcacagggaagaaagagtttgtagtgttaaaaatcaaagaaaggatatagattgaaaaaaaggtcctgaaagaactgtaatataaggctacaaacatactcattgggggctggaggaagtccaacataagccagccccagcgttgagccagtgaatcggagacaaaaggctccctctcttttttagtcccagccagttcataagcctgaggttgaattgcaactatgatttatgctaaatagctttatctaattagggctggtaaaattgaagtggttggaatacctctggcaagaacttgataaaaatttgagagtctttcacgttaattttaatcttcgtttgcatgaaatgggatggttaaggagaagtaaaagaaaaacatgaaaaggaaggcacaataagaagcattcattctttaaaggaaaatggtgtaccaaagagtcgtcccagagctcttccttctcctgcctccacatagtctaaggtctgtttacaggaaaaacctaagctagcgtggccaatataggttttaatgggtgagccaaaaaaaaaaaaaaatgctttcatggcaaaaataccaaaagcaatttcaataaaagcaaaaattgacaaatgggatctaattaaactaatgagcttctgcacagcaaatgaaactatcatcagagtgaacagacaatttacagaatggaagaatatttttgcaatctattcatctgacaaaggtctaatatccagagtttacaaggaacttaaacaaatttacaagaaaaaaaaaaccccattaaaagatgggcaaaggacatgaacagacacttctcaaaagaagtcatacatgtggccaaaaacatatgataaaaagctcaaaatcactgatcattagagaaatgcaaatcaaaaccacaatgagataccatctcatgccagtcagaatggctattactaaaaagtcaaaaaacaacagatgctggcgaggttgtggagaaaaaggaatgcttttatgctgttggttggagtgtaaattagttcaaccattgtggaagacagtgtggcaattcctcaaagagctagaggctgaaataacatttgacctagtaatccaactattgagtatatacccaaaggaatataaatcattatattataaagatacatgcatgtttatgttcattgcagcacattcacgatagcaaagacatggaatcaacctaaatttccatcaatgacagactggataaagaaaatgtacatacataccatggaatactacgcagccgtaaaaaggaataagatcatatcttttgcagggacatggatggagctggaggccattatcctcagcaaactaacgcagggacagagaaccaaacactgcatgttctcacttataagtgggagatgaatgatgagaacacatggacacatagggggaacaacacatgatggggtcagtcagagcggggtgtgaggggagggagagtgtcgggaagaatagctaatggatactgggcttaataagcaggtgatgggatgaattgtacagcaaatcaccatggcacacatttacctatgtaagaaacccccacatcctgcacatatacccctgaacttaaaagttgaaggaaaaaaaaaaagtaaaaaaatgccatcatgatacaattaggcacttataaaaaatgtgttccaaatccctcaaaagtgttttagtaaggggcttactaagtatggagatttcaaatgtggtatgtggatggtgctaaaattgagagtaagcatttagaaatttttagagcaaatcgagaatgctgtaacatacaagcacattgtcagtggactcatgtcaatgagcagggtatggactggtctgggtgttgtggaattctcatagtgagtcacaggtggcatgacctgtgccctagtcatacgcaggaagacacttagaccacaagcttggaaattaaaaaaaaattaaccacacagatagtttgaaaatcactgctttagatcacaacctatttgtaagttaagaggccctacagctcgtttggtgcaaggaagttgacagagagcttgagcatacaccaaaaaatttagatataaagtgacgggaaatttgaagccattgtagaagatacgaattggagatggaactacccaaaattaccttctataaggatcttctagattaaatgcaagctaacttattcttaaaattgttttgttcattatgatatgaacagagtctatatcagaacctggaacatggcaggcactaaataaatattttatgaatattgaattagttgttctaacaacatcgtggagaatagcttgagaagggtaaaggctagaatcagaaaaagtggctaggaagactttaaagactgtctagacataggttgatgggtggattagcctagtggatacagagattcagaaaatatgaatctaagaaatattgggaggaacttccagtttttcccatgtcagtaagcacatggacattcatcaaagtccaaatcagaaatgtggggtcatccttgactcttctctttctccttgctcctcatatttggtcactctctgaatcctaaatatcgctaccctgccttctcctgctattcacactgctttagttcaagccccaccacgtccctccaggactttgttatagcttccttaaatggtctccctgccctgggttcttccccattaagcttttcttccaaaattgaaaattcagtgtttttccttttttgtgtgaaaccatgaaatggctcctgatttaccttctaagcttcagcatacctaagctccatggtagggctgctccttaccaggccttgtgtcatctggcacttgctttgcatgccagtgcattcttctgctccttacttggtggttcttaaaccagaccaacactaaacaactggtaacccctgccccaagggtttgccatgttatttcatgcctctgtgcctttgcttatgctattccttctgcctgaaatgctctcactcccagcaccctggctgcttttccatctgtattcatttcctgttgctgctgtaacaaattatcacaaacttactctttttgaggtcagaagtctgaaatgaggctatttcatgaggctaaaattaaagcattggcagaccttcatacctcctggagctggaggagagacactgttctttgcctcttccagcttctaaccacagtttttgtttttgtttgtttgtttttggttttggctgatggtccctcattgtcacatctctttctctgacactcctgcctcctttttctataaggacccctgtgattacatcaggttcgtctgaataatctaatcttcccatcttccttaaacgtagtcatatctgcaaagtcctcattgacatgtacggtaacatttacaagtttgggatgtggatatctctgagaagccattattctgcttactgcaccacccaaccccaattagtctcttaaagctctgctatcactttttctctgaaacatgttctgctcagagctaatcactctctattttgtgtcatatacatactaccttcactgcatgggttggcttgtattgcacataataacttttaaaacacatctacctctctattatattttgatttcttgaggggacagcttatttatctttgtattaccagcggtaagcatgttacatggtatatagcaagtagtaggagctaaattatactatttaaaaatgaatgtcccaggcagtgcaatgatccatttgaatgttaactagacatgtaggtttaaatggtgactacagttgtggtgcattcctaactttgcagggtcgttgcctaccactctccctgcccacgcttgtctgcttcccctccagtcacatggcctttctaaccttccttggtcatgctgttcctatcccatcctcatctctctgtctgtaatgcccttcctccaacttttcttttcataaatccctaattcattctcaaagcacaaatcaaaactttttccttctgcaatgccttttatttgtctcaagacagaattcatcacttcctcttttgagttgctaagacattttgtacagatctgtattacatatttcacattgtgttttgcttggttttatatatgtatctgttccatcacaagaatgcacaaaagccatatcttgtttatatcagtactaggcatatagcaagcactcaataatgtttatgaccttaaagcgaacatataaacagatgagaatggaggggcaacagaaaggaaccaaaagattaaaagagtgcctttgataaaagataaagaggaaggaagagactgagaagaccctcaaagacagcattcagaagaccctagaggcagagtgtgatgaaggctggagttagagtggctgacctctaattaaagaggagaatgtgagaggcagcaccacatgcagtgagctgcaggcctgagaaagagaaaggctgttggatgtgaccacgaagagatcctaatggttttaggaagcataatgagaatgcccagtcaggaccctgggtctgctcctgtttttaggttaggagagattaggttaggttaggatctccagaggataaatgacttgaggaaaaggaatatcacacttcatatccaatcaacttgcttgaatgcttgaggccatgaacacctcagcacagctccaagtcagtttggaaggcttggttctttcatctgataccacgacttcaaagtactaggagatgtagatggttctcagggaatacagaggccaacataatgtattcccctataataatcagagattttcatcaatagggcacagttggctgggtggtccaggctcctgaggaacaaaggcaaaatgtctaaatctggcttcagaactgagaataatttctctttcacggaacttttctggatgatgatatttctctatataaagcattctctgacccagtggacaaatatttctcacatctctgcctgccttgaaccttgccctcctatcttccatcaacactgctgtcagctgtattctccaacctgtgtcttgtttggctaacctgtatggccaactgtctgtctttacctttacaaagcctgatctagacaaacttctatgctggacatctgcactgattttcgcccaaatcaattgtctagcatctatttctgtgatctgcttctgctgtgtcctgaatcagtctgctgtggtctgataggttgcacattctcaatgggagtgagaattgatcttgggggataaaaaacaacttaattttttaaatgtacaaagtgcagatatacatacaatgcataaaccgatatcacaatatatctgcgtgtattagggctctccagagaaacagaactgatagcatatattatatatagatacacagaaatagatttattacgagagattggctcatgcaattatggaacctgtgaagtcccatgatcagctgtctgcaaattggaagcccaggaaagttactggtgtattataactccagtccaagccagaaggcctgagaaccaggagagccaatcctgtaagtcccagtccaagtccaaaggccccaaaaccagaaacactactgatatccaagggcaggaggagatggatgtcccagctccagaagagagagtgaacttgtgcttcctccacctctctgttttattcaggccttcaagggattgcttgatgcccactcacactgccaagggtgatcttttattcactctaccaattcaaatgctaaccttttccaagaacaccctcccagacacacccacaaataatgttttaccagtgatctcagcaatccgtagcccactaaagttgacacacaaaattaaccatcacactatggtaccaaaatttgatagaggagagcaatttttaaaaacatcggaaaagcctccttaggaaggcaataatgaaaagaaaagggttgagaaatattgtgataggtgatgaggctgcaattcctgtaacagaaggaacataaggagactggattgtgaggaaatggaggtagtcacagttatttgactgagaagtagactacagagagaattccgatgaagcaaacaaattatgagcacttattatgtgccatgaactgtgtgaaaccctttcacatttgttagcaaagagcttctcctttagtagtaatgtacatattccttgcagaaaaaacagtgacattttccattgagacagtagcgcacctatctctcctctgcttcagcagcctttatgctaattactgttttggaagtaactcctcattcactttttgcaacataagataatgagaaatacagcccagattttgtttgtagaagctcctttcatggcagcctttcaacagtttgggtaatttaaaagatgcagttgtaatcgtgactaactcattaagatgcttgatgagcatcttaatgagttaaaaaacctggacatttttaacgcacttttggaaagaggcaagaaaaatataagagtgggaataatccaaggaaaacatttcaagtctttgaacaatagaccctagaatttccttagcttgagataggttaggacaagaaaacagaatgttgcttaaaagaagcccagtgatcatttgtgtctacttgcacttctggaatatgacttttgtttgttagttggttcattttgacttaaaaagtgtttttcggccaggtgcagtggctcacacctgtaataccagcactttgggaggccgaggtgggcagatcacaaggtcaggagatcgagaccatcctggctaacatggtgaaaccccgcctctattaaaaatacaaaaaattagccaggtgtgttgacgggcgcctgtagtcccagctactcgggaggctgaggcaggagaatggcatgaacctgggaggcggagcttgcagtgagccgagatcgctccactgcactccaacctgggcgacagggggagactctgtctcaaaaaacaacaacaacaacaacaacaaaacccacaacatttttctttgttctctctcagtactcattaagaatttactactgcgtctttagattttatctcaggcagatcaatgctatgtatttgtcccctgtacttgatccctgtgctttccttctctcctactttcctactcttgtcatgagtgctgaggcagggatgatgttggggtggaaagctgaagggcgaagatgaatgagccacagtgtccacttagaatctacagccaactcttggcagcttatccgtggtaattcttgtttcagcttcttgttgactttatcacccactcaatgtgcttaattctatgatggatgttatcaccagctctgtttattcacaatgccaagaacaccagtggaacagggaaatattcaggaaaacccactttatggtgtcaacttgaccagaaaacgaaacacaactccatcattgctttattgaatttggcatcgttctagaaataaactatcatttatattttgtcaaacaaaaagaagaggagaagagatttcaaaagcactgcttctggggagggtctggatcaaaggtaaatgtgtgactttaggtgacagaaaagcatctccactcagatgcatccaactttgagggggcactgactacaggacagtagagacaagggacactcatgaacaagcagcttttccaattctgggtccttttcaaactgtagtatcaacatatatttttaagtttcataaattcttggaacattaaacatatccattcaaacagttctttcaatatggtggatatttgtaggctgccctggaaatcagaacaccttgaatttaattcctgctatgacactggctgactctgtaactttcaccttttttagttctccaagatgatataaataatggaaaacatataggactctaaaatggttgcaacataggttcaaatctgacccctaccacttgttagcttgtcaacattggataagttatttgacttctttgagcatcagtatctttatttgttaaatggagataaagatatctttcttgcaggaatgttgtatggatctaatgagatcatgtatgcaaaacacccaacacatagttgtcactttataaatggctgttctagtagccatttgcacagagatggggaaaggctaggtgacaaaaggcatgggcattctgagctcatcagttgatagggcttccttaatgccatagctttattagagaaggaggaggatacagcccagccacataggaactcaggcctcttttatttctgcaggatctggtcaccacaacaatcagaatgtgcaggggtaagactaaggaagagagagagaggaagaatggatggtgggggggggggcggctctcttcttcctagcggcagagaatcccgcagtattccttcagttgcagaaactaaatggaaggcaaatggctgtctgcttgtggtgcatgcaccaagacaaactactaaagtgtttcctgcccagtccccacaggtgttgcttctcagctttggataagtcctccagcaagtactttgttgaaagcgagaaaggcagctgcataactctccagtccacagagctgacaaatcactgtgtcatcaaagaagagggaatcatgggaaatagcctgtggttcaccctctaaggcagggagtcaggaggctgtgaggtggcacatttgattcttgctcattaacatagtttctctttgtgtcctcctcctcctctttgcctgcttgcctgttccactgggtaagcagcaagtgcctactcaaatcattatttatcaaatgtgtactatgttcccaacattcattcaatacacctatattgaaagccttttatgagaataacaaaaataacaagatagattcagagtaagattcagagactgaagcaagtccgcatatagtaatcacatgttcaactagttgttaagtggtatatataatacatagaaaccaaccgtggaggacctcagggaaaggagccaggaagctgaggaaggctttggagagaagatgacattggagctaggccttcacccaaaattccataggtgttggtccattttgcattgctataaaggaatacctgagactgggtaatttaaggggaaaaggggtttattttggccaggactggtggctcacatctattatcccagaactttgggaggctgaagcgggtggatcacttgaggtcaggagtttgagaccagcctccccaacatggcaagagcctgtctctactaaacatagaaaaattagctgggtgtggtggcacaagcctgtaatcccacttacccaggaggctgagggatgagaattgtttgaacctgggaggcagaggttgcagtgagcggagcttgcaccagggcactccagactgggaaacagagcaagaatttgtcacgaaaaaaaagaaaaaaagaaaaaaagaggtatgtttggctcacagttctgcaggctgtaggtgaagcagagtgctggcatctgcttctggtgagggccttgggaagcttacattcatgctggaaggcaaaggggagccagtgtgtcatatggcaagagagggagcaagagggggggggtgtcaggctccttgtaaacaaccaggtctactgtgaactaaaagagtgagaacttgcttatcaccaaggggatggcgctaagccatccatgagggatctgccctcaagatccaacacctcccattgggccccacctccaacattggggatcacatttcaacatgagatttggaggggacacacatccaaaccatatatcactatgggtcaactatatcactatggatccaggggaggatgggataggggaggggaggcagcaagggcattataggcaaagggaagtgcacatatgaaggtgaagaggacatgagcccacagcatgtctggggactggctggtagcttgatgtgcctggaacaaaggctatgcaatcctgggcagcagcagggggagaggtaaatgtggtcggaatgccaacgattttccatgccagtctgtccagtttgggctttaactgtagagaatggggagccattggtgagttttaagtatgaagtgatgggtttatacttgtattttggacaatcctgtgggcttcagagtactgaatggactaaaagagaggctaaaagctgggagacagttaagagctcactgaaattgccaatgatgtcaaatgctgcaaactcatcaaggaaaatgaagactgagaatgagttcattgcatttgacagttggagatctttggtgacatctaaaagtaatttcactataacgactgaagcagaagctggattactaagccagtagttctcaaagtgtggtccctagatcagcagcactggcatcacttgagaatgttataaatgtaatttatctggctcaacccacacccctttcaaaactttgggaatgaagcctagcaattggcatttttacaagtcttctggatgattctgataaatgctaaagtttgagaacaactagcctaaatgactcttcatctcttccccagacgttccttactctgatgacacctgaattatttgatatttcctaagtaatcattaatatggtttctcagttatctgcataaattgttcctgtcagtcatgtgcaatatatgtacagtctctgcctgataatattgaactcattgttcaaggcctaactcaaatgtcacctccctaggaagtctctccaatttcctccaggcagccccccatggatacttgtgcacatatttatgtcataaaatgtatattatttgttgtgttgatttggtttactatcttccctactaactagaagctcttcgggagtagggactgctttatcgatctctatttccatattgtttttacatcttaagtgctcaataaatgtaagaagaggaagctgtaataaattgcagaaataaaaacagaaagggacaaaccactgttttaagaggtttggaagtgaaagatgaatttgaaatagaaatacaatagaaaatgtgtgtgtgtgtgtgtgtgtgtgtgtgtgtgtgtgtgtgtgtgtgtctggaagaaaactgttggctgagggattaagccagtagagagggaaagatgaatgatgagacagtgggaatcagtgggtattgaatgcaaaatggtcctggagaaggcagaagggaattaaatcaatggccaatgctgaagaattagcattgaaagaaggaaagactctttttttctgagatacaacacaaggaagtaaaggtgggtacataagtgatgagttgtgaggttgagatgggagatggtagggagtccttagatggcctgtcagtgtagaaatggtgagggctagggaaggttttgcaggggaggtgatatttgaactaggagatgtctttagtgaagtaggaagtgaagccttttgctgggaagaaaatggggaacagaaagaaggaaagaggctacagcagagaggtgaagacttgtaaatgctagggaggggattggagaacaacagcaggggattcttttgggctgatccatctccctgattcaagacaaagaaagagtccacttattcatccaattgtgattggcaataaaagaagtatggagggattgtccccaaaggctgtctttgaaataagatggacaacttctggatacagatcccaatactaatatagaaagtattctagctctatatattaattaaggctggaatattttgcagacaataacaatgctatgtatggcaactatgtacaacaaaggaaaatatttatggtatatgaattgcctaagaaatctggataaaaactatatgtatgtcggccaggtatggtggctcacgcctgtaatcccagcactttgggaggccaaggcaggtggatcacctaaggtcaggagttcgagaccagcctggtcaacatggtgaaaccctgtctctagtaaaaatacaaaaattagccaggcatagtcacgtgcgcctgtaatcccagctactagggaggctgaggcaggagagtcacttgaacctgggaggtgggggttgcagtgagccgagatcgcaccactgcactccagcctgggcgacagagcaagactccatcttaaaaaaaacaaaacaaaacaaaactatatgtatgtcttgattacaactctgtaagaacatacatatgaagaacaaatgaataaaacacatgaaaatgctattagtggtggtattataggtcatttttcctttaaattttaaattgatgttttaatgtttataattagttggcaataaatagaattttttttccttgctggctttaaaaaatttactaggaacacttagaagagagtatttcaaaataaaaagttgtaaggtgaaaacaatcagtagaattgtatgaacacctcccatataagggacagatgccaggaaaagaagtccttaagttgagccagagttggaagctgacaagcaagaggttggatgccacgatatagaagagcacaaaagaggtatatgacctagcccttgactcacagtaaacttgagagactaggcttacaataaatgattcgaggataacttattcagttatctaaacaacggatgggactggatcactgaggcagtgacctgtgggcaggcgggacaatgcagaggtcaattatgtgccatcggagttgatcagatggacctgggcttaaatccctgtgccactgcttagcagctgtgtgatctaagacaacttactcaggtttcattttctgcactgtgaagtagaaataataataccttctcataagctgttgaagcattacaaacaataaagcaggtaaaatgcttaatacaatgtttgacacacaaaattgccattatcgttattaacgctttattgttgtgtcatctatgagtatttatgatggaggaaactgatttagactaggggcacattgaattctttggagggacttcagggaggtatcttaagagccgtgagagagtctcaggaggcagtgaagactccctcactgctggaacaatgctgtgggctcaccctaggccttcaggaggggagagagatgtgcaaggaggaactccatggtggttcttcttttgctagtgtttgtgctacttccccacttctaaacaggtgcatagtactccatagcaccctttcatcttcctttcccactcttctgttctgtttttcttctcttcaactcttcttacttcccttttctcctcaaaaccaagtggtggatgggtaaggaactatactatcttttgtgtgttctaactttgccgtttttttttttttgttgttgttgttattgtttgttttaatttttgttttttcttgagacagtgtctcactctgtcacccagactggagtgcagtggtgtgatcacagctcactgtaacctcaacctctggggctcaagtgatcctctcacctcagcctcctgagtagctgggaccacaggcacaagacacatgctaggctaatttttaaatttttcatagagatggtgtctcgctaggttgcccaggctggtctcgaacttttcgcctcttgtctcagcctccaaagtgctgggattacagggtgagccactgcacgtagctcggatataattgttgagtagctgaataggagacctaagtcagccttgaaaatcacctgttcctgcttattttcagggatctctttcctatttgccaataaacacattttagtggactaatcatgaatcgttttatggttggcctcacatttaaaatgttggtggtgctcctcctgccctccaaagccctttatggagcacattaacagagccctgccagcgttacaagctgggccccacctgaggttgtctccattgccccctccacccactttactggccacagaatgtttgtgctttggtgttttcatcagttgagttccttttgctcaccaaagaaacaccacaaaagacacttttgccagaaaacctttctcctcccttgcttcaaatacatcactttacaaagagtgttttaattaaaacagcttataaaagtttatgctttggatttttttcctcccagggaaacagtattcaggctgcatagagtcattctacttggtgggatgactgtcctaaagatgtcctttccctaagcccaatttccccaccagagagaagagcctgccagggttgttagggccgagaagatggtctcagatgcagcagcgtgctgggcccattgcagagtgctcagttcatcttctgggtagtctgtgtctggtttcatgccaggagggagagctaaagggaagctacagaagcatccacggttggcaggactgttggacatttgcggcttcagcagggtcaccctgtttggttgagcaggttgtttctgtacaaggcagcgagcatccagggtctgagtcagggactgagatccagactgtgccaggcttgacctatgcctgccatggggctgggtattagtttcctgtggctactgtgatgaactgtcaccagctgggtgccttaaaacaacacatttcttctctcacagttttggaggccagaagtctgaaatcaaggtgtcatctgggttctggaggctcagagggagaatctgttcttagcttctggcggctaccagaaatctttttttttttttttttttttaatcttaaaggttgtcttctaacttcagcactcagagtttacataagtaagcctgggtttaccctacccactttttcccttatttttaaaatatctatttccccaaccattgtctttagtaagtactctaaaatgacagtcatcagcagaaacgcaaggattccaggccataagagtttgatcaagaaaggattttttgaggtagctatatcttgcaaaagaaacagaggtgtgaactgtctgcagggctcttctcggcaatgaggtgttccttctggattcagatatagatcttaatggggtaaacattctaggtcttaccaccatctgttcttctttttctgcttagactgttagtacctgttataagaggaaaggaggcaaaagtgtgaaagaaaaatggttggatcagtggtctgagaaagaggataaagtagtcatgtgacattattcttaacagagattagaatgattaaaaacaaaaacaagttggtatccaggatattcaggtacaaccaccccttacctgctgattccaatttcacattccattccacattgatgaataataataatgatgtacttttagctttgtcagaaatcctatctgcatatttataaggtcattatgtttagttgttgctgatacctggtctgagtccagcaattaccacctctgtctctttgcacacactggtagacatacacaccactgatttgtactttcctataaaattactcttcccctttttaattagagtgttttcagaagcaaaccctatcgttaaggccatgtatgcttccattataaatacctgtttccagccattaattatctcccaatgaattacttacttagaaggagatttttaatgcattttttttttttttttttttttggagacagggtctcactttgtcacccagactggagtggtggagtggtgtgatcacggcttactgcagtcttgacttctcaggcacaggtgattcttccacctcagactcctgagtggctgggaccataggcgtgcaccaccatgcccagctaatttttgtattttttgtagagttagggtttcaacatgttgcccaggctggtcttgaactcctagcctcaagcgatcctcccgtcttggcctcccaaagtgctgggattacaggtgtgagtcattgtgcctggcctgtgcacactttttataatgggatttctcttccttacttttgatgtcccctctctcatacttagttaaccattttgaattccacttagtaagaaaagtttccattttctttttcttcgggggacttagatatgatctgcacctagatggtaagaagattttccatattttgaagtagaaactttctgtatgcctgaatcttgctgtcaagaatgtcttggctaattatgaaggaagaatataagaatgtgagtaaaaacaattcaacagtccctgagaacaacgtcaataaatattcaaaattgcataaccattttagtgactaaagcactgagactcatccaataatactgtggtttgataattacacagttgtgaatttatgatactgttaaattggggagacatcttggtgcatacaggtcaaccttttcatacatcattatatacaaaaagtacacacctacttaggaattgaagtgtaatacctcctagcataaaatgcttaaaagaagattttaagggagtgatacagtgagcattcctatatgaattttcctgcttatctcaagcatagcagaagatgtgaaatttctaggtaagtttttttttttttttttgacagggtcttgctctgtcacccgagctgaaatgcagcagtggtaacatggttcactgcagcctcaacctcctgggatcaagtggtcctcccacctcagcctcccgagtagctgggactagagacatgcatcaccatgcccagttagttttttaattttttgtagagacagggtctcactttgtggcccagcctggtcttgaactcctgggctcaagccatccttctgccttggactcccaaagtgttgggattacaggtgtgggccactgtgtccttccttaacataataaaattgagataatcacattcataaaagggcaaaactatgtcaacaagcccactgtattagtctgtcttcacagtgctgtaaagaactgcccaagactgggtaatttataaaggaaacaggttaactgactcacagtttagcatggctgggaaggcctcaggaaatttaacaatcatggcagaaggcaaaggggaagcaaggtaccttcttcataaggcagcatgaaggaaaattaatgcaggaggaactaccaaacacataaaaccatcagatctcgtgaactcgctcattatcaggagaacagcatgggagaaaccgcccccatgattcaattacctccacctggtctctcccttgacacatggggattacaattcaaaataagatattgggtggggacacaggcaaactatatcgcccatattacaattacttacattactgattcccttaattagagcagaggtaattaattgggtctaggctcagtggaagggtctggctggttcttaattctcagagctagtttgaatcttgaggttaacgtcttgccttctagaacttgtcctgtgtttggctgaactctgtgaacctttcagaaagtaggtctttattgagcacatactctatgcaaggcaaagaaccaactactgtggagtttacaaacatgaataaggggtaagaaatgactcttgtcacatggtttacagtccagctgtgtgggccaccacagttcatatctttcaggctggggactggatgagaggaaagtggactcaaaattaatcccagtgctctctactttcccatatccctgtgctttatctctgttgtagttatgttatttgtatgttggcctgcctcactgctctgtgatctccaaagaacagggactaggttttatttatttctgcattgccgcagagcctagtatgtgctttatagagaacaggctctcaaaaaaattttaaattaaaagaatgtattcacttgtttatgtttcctagttacagtgggccagcttgttctgtgctaatatggaagtgacaagaaactggtgtccctctacgcagaggtccccacactaaatatcatcttggatgtgcttcacattgttgcacaaaggtacagtggagtgagactgagtaagaggacagaaatagtggggggtttgtctcagctcactaattacttatttaaccttgggcaagatacttaaagctctatctcagtttcttcatctgcaaaatggggataataatgactggggtgcctatttcccacgattgttttgaggatcaaatgagataatataattaaaagtgtttttggaaggtctaaatcactgtgcaactgcaaggcattattaaaagaaatcttccttttaattcctgcttccacaaacatctcatcacatatccttgggtccctgggttacatggagagattcgtggtgtagctcaatctatgtgtcatagctatcccacaatctcttcttcaacttctccaacacaccaagacattcttccagtcttgcactgctccccagtttatatagatatatatgttcctcattcagcatttatgtaaaacatatattattgagcacttatgtgatagaaaccggggcaaaacagaaaataaaacagagttttattttgagagttttttacagcttgtcggctctgagaggacagacatgagaacaaataagtgcccaattctgcatttattttggaaggcagttttatgtgagtttaaatcagtaaagacatagatgtatatttttagttttgattaaaactaaaacaattggtagcccttactcatatttttctatcattaaaacttatctttaaaaaatgtcttcagtcatatttttcccttacttccattcatatttactctttacttctcttgtccttaccagaatgtatgcagtaagttttcatattgtaacacattcaacaaaagttatatgtgaacataatagctgctttctttaaaacggttactttgagaaactgcatacctatttttttttttttttttttgagacggagtttcactcttgttgtccaggctggagtacagtggcacgatcttggctcactgcaatctctgcctcctgggttcaagtgattctactgcctcagtctcctgagtagctgggattacaggtgctcgccaccatgcccggctaatttttggtatttttagtagagacgggttttcaacatgttggccaggctggtctcgaactcctgacctcaggtgatctgcccacctcagcttcccaaagtgctgggattatgacataagccgccacgcctggcctgcacatttattttaataatgttgtcatagctacagtcgcttctagagttgctctttggggataactatcttatattcttctgaatatattttaatagtgacaaaacttatctttgcaggtgatttttaaaatttgtatgcagccaagtcactatgaattatctttagtgagtaaagaggaagatcgaactggtaacactgtgggtaaacaactgaaaaataatgttatctttctctgaacatacttgcacaagacaaattccaaaaatattttgactacgttatttttgaaaagggtttccagtatttcaatgtgactactttcactaatgatacttgcttacctaaagtgcttgttaacatgcagttttggaacttcataggtctatgcccatactgacttgtacttgcttagtgttgttttacattctagttcaacatctattatgtgatagacactggggattaataggctgtggtctttgcccatgaggacctcaaaacttagttgagaacacagaaatacaaagagtcctgtgtgaaaaataagtatcggtgttaagataaagaagcggcagtggaagacagtggagggactgtctgttagagggaggaatttattgtggtgtcggcaaagccttctttggactgaaggatgaattatgattagaagttcattaagaggaggagggaaggggactacaggagtcattccaagccaaaggaacaaaagatacagggacagaaacagcaagatatgtttgggggaatctcaagtaatactgttattgtgtgaagttcacaacaggggcagggaggacaggagatggggcccaatgacgaaaaggccttgtatgtaccatgtttagaagtttgaattttatcctataggagtcagggagaggttctatgggtaggatttctcatcccaacaggattgtaaactcccacatccaattagtcacacctccattttttttttctgtttctttaacattgtctcagattcattccttctgaaatctaccttattagttcaggtcttcttaaatttgtgcctggactgttcaccaactcttgactggtcctggggctccagttcacctcttgctcccaacaatcaattttctacagaattatcagagcaatcttcctttccatcaatctcaactctgttcaaaaactttcaatagttttatgtgacctaagaggtagctgcctccccaccctttcagcttgccattcaaggctgcataatttggtcccaaccccctttccgtccttgactcctctcactgctaacagagacagaactcatttacttactcttctgactgtacctttgctttcacgagggctctttcctggaatgatatgtccatacaactattgttgttgttcttacttttagctcttttcttagcccacttgtacccaggtttgatcacaccccctactctcctgccctggaagtaactactattctggttatagtctcttaatatctatatctatatatatgcatccacagataatgtgtagtattgtcttgaaaaaaatatacataaatggtatactttgtctccctctgcgattattttcactgtcatttagtttttaagatttatccctattgacataaatagctatagtcttttcaattactgtgttgcatttcattttataaatataccatacattattcatccattcctctaagggtgggcatttatgttgttttcaaggttttgctattacagtgttacaacgaatatccttagcttagctggtctccttgtcttatacaaattttactgacctttcaagatcctgctttcatcccagctcctctgggaaagccttccctgaatcccccagcccacagcggcaaagtcttggtactcaaagttgcttgtgcatctttggtatcatcccactgccaagcacacagctacgcaaagtaaggcacttaagaaatattcgctacacggatgaacaaatgaatgaatgaatggggcagcaccactccgtgatggctctattcctttttaatggactttggcgccttggcccactttccttctttgacagcactggtcctactccagagcattcctctagctagcaaagcagtgtgtggatgtgtgggtgtaggtggcgatacagacctcactggatgaggaccgcctctccctgcaagttcacgatcccggcaaactccagtgcttgaagttcagagtcctaccccacccccctcacccccacgccccttctgcactggtcaagccagcgagccgctgcagccctgatcgagttaaggcgcggcggcccccggggccgctggagaaggatgcggacggggccagtgactcgtagtagatccctccgcgcggagctcgggccggcgcttcttcctgcgggaaacccctgggtgcccaaggcggcggggccgaggccgcggcgacagtggggcggggcttgcggtgggaggaggcggctgaggcggaaggacacacgaggctgcttcgctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggcggcggcggcggcggcggaggaggcgaccgagaagatacccgccctgcgccccgctctgctgtgggcgctgctggcgctctggctgtgctgcgcgacccccgcgcatggtgagtatcgggctgaggggcgctgtccgcggcgcccggggctgccacctggggcgacccttctccccctcggtccttctctgtgtgggaaggccaggctcggccgccggcgcggagcgaggccactcgctgggttcccgagagtttggacatcgccgggggcccctcccgtggtgccccgccaaccgccggggttccccgccaaccgccggggttccccgccaaccgccggggttccccgccgcctctgctccccgcggcccgggacccctcacacgcctcctcggcaggagggaggccggcagcaagtctcagaaactcctttttcgtagtgccagggtgcagggaggtgggcagttttgcccttcaggttccgcgtttcctggggtcgagcgagagccgacggcgggcctcggaggggctgagcgaaggaatgccagattctggcgtggagagcgggggcagggccgccaagccaaacggcctgcaccttcgcagccagcctcgcctttgccagggggcggcacatgggccgggtgtgtgggcttggtttggatggggacggggttttgcggcgcgcctgagttttgacactccaaccccaccgaaagtccggaggagccgggtgtgctgctcgcgtctttgaaaggtggaggcaggagaagtagggcaactggtgtggctgcatgctgaggcacatgatttaaaaatctcaactgctgttattctttctgaggcgcggagctctgctgctgtttcaggctgtgtccagacccaggaatgtggtgtgacgatcaccaattcctccaacctggcagcagcatttgctgctcctttggcatggctgggggtggggcacgggcgggtgagaaaaagtggatacgtcaattcaaagggcttccttagaaagcttctttgtggttggatgtttctaacacggttggaccaaggaaagggaatcaaatcatatcttccccatcccacccacacttttagattctacatttcttcagaccctttagtggaaataacttgggctttggagccctgctctgtaatcctggattcaaatccagctctgctatatgaactcaccaataaaatgggaatgaaattatccagctaataggattaattaaaataatgtatattaaacggatgacactccaaaggtgttcagaaagtcctttgagggccgaggctgtgttttactgcttctgagattgatgctcccagtgggatggtgtcttgtgcatatttgttgaacggaaagcagccccttctttttctgagcctaatctgaataaagatttttaccttcaccaaaaaactagtacatgaactacatctgttttcaaagaaaaggttaggaagatgatgagcttcagaaaaatatggtctttgttcattgttaacagtcagtcgacatgtcaatcgcagatgtttaaaaagagaacaaggttatttatcacccgaaaatagtactgggttgttcagcaccaactagatacttcttggaaagttcaaatttcgtacacgtctaggtcactaagaatttcagaagtggaccaggaggctttgtagtgatgaagcagagctgttgtttctgaagcatttaataaagagcatatatgatggtgtttttgcttttcctttttctttgagtgaaagctttaagtgtagctttaggatagagaggagtataatcaatgagacagtctgagggtaataatccttggtctatcattaacttgttttggtaaataacttaatcttcatgatatgtagtctcctcacctatgaagcaggactaaaggaataacctgctttagagaattgtagggaataataaatatgattgtaaagtgatttgaaaaattaagtattaaataatatgtcagaaatgggattactctgacacatagggcttcttttattataggatctcagtgcgtaaaactatgccctccacctctgctctgctgaggtgctgcgattattagctagcttttaggtagtcaagttgagtgttagtcaagttgactcaaaggataggatttagatattttgatttttagacaggtgttctttagatgctaaactaatgcagtagaagagatttagaagcctgtttcttggtacaaatcttaaatcttcttagagtctacagtgaaggcttcttgaatcctcctaatttattattgtgttttgctaaggtaccaattacagcacacccttctaaacttttgagtgttcctgtgtttggcttgtggccaattgttaatttaaacatcacggagtttctaaggcaaggagatgttagcagtatgtctgattgtctaaacagctatccaggaccatactcttgctccttgttttcttttgctttgcaatgggaagtgactccctgattttgctgcctgctagataatttctcagctgaattcttctcttgcttaaacaaaatcggagtaattttctttcagatggtgatgaaatttaacctaaaactatttttcctttcactttcttattattcctttttttttggtgtggtggagaggaggaggagagtgattcctagtctctcttatttttctgaatgtttagatttaaaaaatatttacccataacttcttgggatctctctgctccattcccaccctactgcctctcctgtaggcttctatgacatagagaagcaacttttggttcacctggattgtagttgctgacttcaggacctttagagaatgtttaaattcagtgggatatgcttggatggttcagagcagccttacaatacattttaaaaatatcacacccacagaaattctattttgcccacaaaatttgcattgatctagttcccactctgtgttgccattcctagtgatcctcctccctacctctcccattatggtagaaaaaaactctgtgtcctggctacatcaaaatctgttggggtggatcttggactcagcacccagggattctgataaggtaagtttgagaatccatattttttcaaggtttacaggtgattctgacaagtaacttggttgcaacccactgattaagtacattttttttttaccttcaggtgtgtgtatgaggtctttctaaatttaagaaatttccataacaaatgtaaccttagtcattccagtgtttaacacttctgactcaagaattttaaaattgctaacgtaagagatatagaatataatgtcatttcttctgtttatctgggtgcagtatgtctgcattgaccctttagaagggcttcatatatttagatgatataataaattctctacctctccttttcccttttcttctgttatctctttttccttaaatgtcattcatacatgttgttttttgaccctttatctatatacgtctgcaatgattttagagtaaaaaactgcaaggcgtgatttgaataaggatataagaaattttacatcattttctttatattgtgttcacagtccatagttacatgcttcctttcttgatgtctcagttcgaatgcctaaatttgaactattaattttccttccaccctttcctgattttcctgtttttgtttccccccctttctctgcaaatgacttgaaaccaaaaggtcttcttttctttctttgtcagtctaccatatgtgtagtattttggacagatcactgaactaggagccagaagaccagaattcttctccaggtctgttattaattggtttggtgaccttgtaggagagccactgttttggtcctccattttctgatgttcattgttcatggtcacagagccaattagagttgagactagaattcctttcttctggtgtccagtgcctcattcactgtccacattgcttccatctcgtgtacaaatgcgcttatgtgcacaaaaactcttataacatcctcaagtgcttattgttaatgcgtacatgaggaaggaatcgtgtattttcatttatgtgtttattctaatgcccataccctacccctgtacctggcatgatgccttggtatctaataggcacacaataaatacttgttcagtcgaacaattatttttagccactttcttattttggacaactgtggtactcctagacattttaaaaatagtatttgcaggagtcatgcttaccttacatttggggaaaaaccaaatttttcccttccccagatgtttcatttaaacttgtaattttgaatttctttgtgtgtggggtttctttctttctttttctgatcacttctgcaatttataaaggtcactttgactttggaatctcacttcaaaggcactgccatccaccccctgcctctcattcaagtttgcttccactgcttcctgtattactgtattactaggccagcaatttctgttattttgtccagaatagccacaccttattgtaatttcatcattttggggactagtcatttttggaatactatttttaaaattagagttaactaagtttatatttattttgataattttttttgagatttttttcattgagttggatattgcaaacttgtactggattgagagaatatgtacatttagtaaagtatatttgctttttttttttttgaaccaagagagtcccctgaacaccctactgacaaaaactaagggtgaaatatgatgaataaatatttgagagaatcacatggtgttgagttgtctctgccacatgattttgatccttgagggccaggtctgtgctacacacatttcttctctgtactacagaacttgtctggcatgtgccccaaattcagagtcaactgagcggcaggtcttagtcacagcatctgtgactcctgctttcccacctttagaacattctataggagaggctgatggtgagttggagtgtgtttctatgttcttttttcctttgaagagataggatcagttgaaagctgaccccacccacagactttttttgctatctcttttaattaattaaggagtggctgaaattttcctctttgttgacttatgcattggtgggaactttaaaattcatctagtctttctgtccatcccatgctggatctgatgtttacaacattctagtcaagaggtaccatattttctctcttcttgaacatctcttgtggtagacagctctccacagcagtttattccatctttggccagctctaattcttagaaagatcttcttatattcagctgtaatccatctcctcatgacttgtcctcattgacatctactcagaaatttgtctcagagtcctgagacctgtgcaggtgatagggacccaaagagatgcttgtctgtagactttactgagctgacacccagctctccataaaaggagtcaaacccagtgaggagcatgtctggggtgattgctcaggtaaagcatcttagccctacttgtttcatacctccctgcacaggtgggcactggtgggagaataacatttatcaagcagtgtttccctaacctctcttatgataagaatagctcaggtgttctcatggagattctgattcagtgcatctggaatgtcatctgggaatttgtgtgttcaagaaatagccaggtgattcttacattaggaaagttttagaatcactgcagagtgaatctgggaaatcaaagtgtttgtttttgtttgtttgttttttgagagtattagagacaggttgctttggctagatcctgtggtcatttttcccccttggaaatgcctcctacttgctggcctcacttagtacagagaagaaagctgctatggtataaggttagtaaagttgtttgttttgtcttaaaagaaatttgcgaaatccagcattttcggacttctgtttgtgttgtatgactttgttgtaagcctccttattcctccattagaatgttacctgagatgttagaatgcataggagttccacagcctttttggtgtccactaaagaattctgtcctcagccgttgcaaatggtgcttcctttgaggatttctgcttcgttagctcatgaacacatatttggtgtcggcagtttccctcagatgtgttagtgtggagagatataaaggtcactcatttctggtggtcctgcttttggggtttctgggctgctgcagcaaatgaaataaggaaaggaaaataaaggaggaatctagggcttcttgagcagaacaaaacaatctgcaagaaggggcacaggattgctcctctcacaaagacacttgataatactgtccttgataggaagaaggaagtggcttcagatctgaaaggatatgctcataggcttgagacgggacaaactgcatcactggtagtggtaggaggtttgccgtagatctgttttttctcctgtctctcttttttgaggagaatattatctgtatggcagaacatacattgtggtcttaaaaaggagagtaaagccaagaaagggggatgataaagccatagcttggaataagaaaagcaaaggaattattgtattaatttgtgtatgtaaatacataggtttccatgtaattcactggtaggatcactagcccttggcactaacatttgctatctttgtagctctgctgtcttagtggtgtattgggggagcattgtggtgtgttgtcacacttaatttgtgtgcttcccttggcatcatgtggtagcaagtacagggtattctactcttctagatgtgtgggaatcattgaccaagtagaaaatatggtcctgctcccaaggagctgacatcatcatggagacaagacagataagcacacaattaggaatatgaaatacagttattttatcatttatctatgctctctgaaagcagtttcctgcagtcagggtgactcagagctatagggtcttgggagtaaacttcaggtcttaataccaccagggaaaggcgacctccagctcacccttgctgggcttgtctgctgtcgtgagctgtctgccattttcctctttctgtgttgtaatttagaagtattagaacttggcttggggaaaagacaaaaacccctttgtctggtgagggtgtaaatataaatttggcacatgttgtggtgtctattatgtctgttagtgggtttgcggcaagagagagtgctgtgttcttagtcccgaatgccaagcctgaactaggacaagttatggtggaaatatcttccttggaagatgcagttctcagtggcagtggctgaaggaacttctcgtcacagccaggcagtgactgaagtgtggtgtggacacacccagagttgctgcctcaggtggcattgattaatcatactaatatctccctcacccttttgtacttgtcttggcaaaaccctgttctactagctccccaatagtttggcctttactaggtatgattgaacaagctcttgggggttcaccttagtgtcccttgcccctctcgcatttccagccagctacgtcgctccagccatggtaccccgggtcctctggccaggcagtgaggggctgggtttttcttcccattggactgaagcacctttccctggaggcttgcctagggcagtttctggtctctgagtcagttccttctgcaggatactggcagctggcagaactctgggttatttgaatacatcagccaaacatcttgccaagatggactcattgttgcataacgacaggttggatctatgggtgttgcagaacctgtttctgggttaagagtaactctctcacctttattatatatgtttattcatatgatgaatgtatgtgtgtattttgtgaagtaaggaaaacatgatgataatattgtggttggagttagataccttatcctaaatatgttgtctttttaacaaatagcattcctttaaaatacagttgtgcttgatgaataaggtgttgtacaagaagctgtggttacattctaaaataaactgccttgttctgaggcaggcacgttttaaaattgttgtttgcttctttttcatctctttttattttcatctttttttgtgtgagaagattctggaagtttttaagcctcaaatattttcaataatctattttaacgggtacctagcagggagaggttgttctattggtatacctaaccaacattcaaataagaataattgaatactgtttactcactaatctattctgttgagtttctaagtatgaataatcacaaaactagatagtgctgatatattaacttctctaaatggtaaatgtggtaagtagcaaagacatttttgtttaattctctccttacacatgctttggttcagacgctgtcaagacacattgaagtttgaggacatgtgtatttcgattattttattatatttttatttgctgtgaatatgggtttatttatttgctagatcttctttagttagaaacattaagggcatttactttattacaacatttaaagtgcattctaatcttcatgaggaattttaggtaaaagaccgtatcctgagattcatgcaagtctttggcattatgttactatttaaagtaagtaatatgtagtggcttctctgacatattctttctaagagagttaaggaaaatagttgtaactaaaagcaaacattgaaacagtttaaggtaggtttacgtagcaacagaattattcgttatgtttacagataattaactcatatttatactttgctgattttctctggcacctttacaagatttttttatttttgtaatataaaaagtaattatgtttgaaaaagtagttaaggatgtttgaagaatctagaaaagcataaataaaatgtccacaatcatgctgccattaattttttggtatacgtctttggtttttttacccttagatttagaaaagctgttgatttatttatatatatatatatatatatattttttttttagtttatgaacagatctacatatatatatatgcacacacacataatatactattgtcaacactaggttttatttttaaaaatctttaccatttgataagtggtaaatattacttaatcttaatatgcctctctcattacagtgatattgaatgttttttcatatcatcagtggcgtttgtattgccttttttcctacttcttttgtaaattgtgtcttttactcatttaattattttcttactggtttgaaaaagctctttaaatattaagggtgttagtcttttgtcttaaatatgtcacaatatgtatggaaataattagcagtatataacataacatcaaattgctaccaatgttgatataaaaattgttcatttcataggttaattttttttaatcctttggtttctaatgatattggttaattcatttgttaactgctattttctgtagctacttgaaagttcttatctgactgtatcgtaaatcagcatgctttcagctgtatatgtctaggaaattgacatttactttaatacttaataaaaaaatatgttggagaaaagcagtgtattctggagtcaaatacatgattttgggtgggtgacgtaatcggctactgtcctccttttctagatagccaagatttttgaagcatttaacatccctgaaaggcaggactaatgctatgtctaccatgcactgctaattctgacactttgacctaatggataaatgccagtacagtgggtctagccagttagcttggtcagagaacaagatgactaagattctctccccctttcctcaccaaattgattagttgtaggacagaactgactgaagcaacctgttgttttggcaacccatggacaccacctgtttcttccattcctccgtccagcctctcactgccctagtgcagtgctgtgtgcatagtgggtaggagatcaatgttgttgctaaagaaagtagcaataaagaagagtagattgctttttttccaagcttttgtgtttttaaggcaccccgctggttttgacattcgttgctccagctgaactgctctatgctgaagccctgcaggtctcaagtgtttggttcagagtaatttcaggccatatgaatgctttcttaagtatcattggaatttactgggctggctgtctgccagctattaccatatttagcatgaagagacctggggaatgaggacatttctgatcaaccaaggaaggaaacctatttgaaggattacaatattttctttttttttttttaatggtgtagttcagaaaacgccagttagactgagactcagatttatgtccactggtctttgtttctgtgccccatcccaaaattaatttatgaataggaaaagagatttgatagtgaagttctttctcactctgaagtctaatactgtttctgggaggaagtaagagaattattatgcccacactgtgcactgagaggcttaaccagcaggtgaagctgttgattaaaaacataggttgatgagtattctcatttttctcctttgaagctttcagaaattttctgctttgtcctggtctaaatttattttggcccagcccttgtctccaccctacatttcaaaccagtagccttccctctatggctcaacatttctctgcctcagttttttccattttaaagatgaagatattgtttggaaggaccagtaaatacaattaatataaaaattgcttctgtagaatcaaacaacctccaacatttctgttggaaatttatagtttatagagtattcttacacaatgatctcctttaatcctcacaaacttggtggaaatggagcctcacaggggctaggtgacttgtatacattgtttacccctacataataagtgacagagctggtacttaaacttgtggcttgatttttctttttttttttgagttggagttttgctcttgttgcccaggctggagtgcaatggcgcaatctcggctcaccgcaacctccacctcccgggttcaagtgattctcctgcctcagcctcccgagtagctggaattacaggcatgcaccacaacgcctggctaattttttgtagttttagtagagacggggtttctctatgttgggcaggctggtctcgtactcctgacctcaggtgatccgcccgcctcagcctcccaaagtgctgggattacaggtgagccaccgtgcctggtccttgcagcttgattttttaaacatcagatttttttttcttttttgatttttattattatgtgtctgtcattctgctaggggctttgcaaatattgctttatttaattcatatggctatcctttggagtagacaatatttttctacattataggtaaggaatttggaacttaggttcacagctttggatgttggcctatggttagtgaggggtgtagccagcattcaaacccctgtctggctctagggccgctgcaataaatcatggtgttttatgtacattcatacacttaacactttgcaacaaccctaagagacaggggtaggtatttagggaaactggggcttctaacttgcacaggataatgcaattagtaagtggcttagtcgagattcagagctagatctgtctccataaccctcactcattccaggatactgcagatgcctatttttatgatatgtataagtaaaaattaatttaaaaaactaccttctttgaagggtcagccagttagaactcttttgtatcttctgaataagtaagaagtggatggacattagctgaccgatacattgatggcttttaaccttctatcagttgatttccattaccaggacaagcaaatataatttggagggaaaagaggggagtttccattaaggatgaatctttaagccgaaaagggccacagtgatgaactcttcagaggactgctctcaggagcaatggcccttctcctctgggctctgcttggggcattcctgtttgtatttatggagacatctttttgaaaggcagatgccagctttggtggggagaaggttggaaaacatacaagccttgctctaaatttactagccccgtgtctttgggctagtttctgaagcatggtgtgcctcaattttattattttaaaaataaagatagtagcagtatattttggagttgttatgaagataatatcagttaataaatgttagattcattggacagtaccaggcacatagttaaagtgcagtaaatagtagttattgttggtattggtgttattttatgttgcagtacagactggcttcttggtgcattcacttttctttaatcaaaagtggatgagtgattgggaaccttcatgaggaaataggaacatcatctttgcagcctgtggattgttcactggtttcctgtgatctaataattatttaagggtttcatatttgagtcttttcccttaatgaggtacactttcagtttggggagattttatctataggcataccttattttattttgtgttcccttttattgtgcttcacagattttgttttattttttacaaattgaaagtttgtggcaaccctatgtcgagcaaatgtatcagcaccattttttccaatagcatatactcactatatgtccctgtgtcagtattttttagcaataaagtatttttaaactcaggtatatgcattatgctttagacataatgctgttgcatgcttaatggactagagtatactgtaaacataacttttgtatgcactggggaaccaaaaaatttctgacttgcttcattgtactgtttgctttattgaggtgagctggagctgaagccacaatatcacaaaggtatgcttgtattatgcaagttgcattgataggtgttaaatcattttcccaatttttattaaccacacatttgtgattggatgttatgtttagtaaagatattgtgattttctgaggtacagctttgagaacagtatcaggtctaacactcttgtttccaaatttcctatgatatgacaaacataatcacatgccatccagtgtcaccatgcagagtactaatgtgaagccaaaatacttggtgttttaattagccttaaagcagttaatgaactatctctgttagacattttgaaataataaaaatatcccattgtcttttattacaacctcaggggctcctggagattttgggatcttgtgtggggaaccacccatctaatccatccttgttttaaagagagaaaaccaaagaagcaaagtgactggcccaagtacctagagctgggtcagggttggggccagaatccaatctcttgacttttagtcaagtgatttttccactatgctcagtactcaaattatgtatcaatatgtcggcccttgttttttgaggtctgaaaagggttagtgccagtcaacaacagtagaggagtagaaagggtgttgggatgggagaggtgtggctatatttaaaatttcaatgacagcagtgaaaataatttgcctgtgaacctctgcctgtccctttggacttctttgtagtagttgagacagcccggcaggtctggtgtcattagtgattcagaattggattaacctggactggtggagttactttctcagaaaagggctttatattttaacatttgtttcccttgacagtttgcttcttctcaagttttggcagccttgaacaagtggttgtcaggtttttattttgttttgttttaagaaaaaattccaaattttattttgccgatttagtaagttatcctctacctgccactcccttctgctccctctataattatttctaagactttatttttccattgtgggaacattatggaaggttttcttttacagtctgagatatttataattatgtgtaagcacacagtttatagaatatgtaaatggtccatatgttaacttaaatacccttaaaatattttccaataatttaaatctttccataaaagtagctgaagctgcttataataaaagagaagtatacacgaaggatagcagaatttggatgtagttaatatagataaatatgaatgtcactttggaggaactggaagtatttgcatgaatactgatcaagtcatgcctccttgttaatagagtgaacaaaacagatgaatgtttctgttttcatgaagtttatgtgactatcagtagcttccatattctgagggtttattatgtgacagatgcttggggacaaaatactttacttgtttcctttagtccttaaaatagatgttaggattcttgtttacagaaaagttaaggaatgttcatccagatcacctagccagtcagtggtaaagaacagtcactggaacccctctttcctgatccaaagccaacatacttaaccataataaataatgccattgtctggtggaatcctgtagtcccttagatagtgtaattttgtatttaatgtaaacattttgtgcactaaactgacttacattttactttttaaaacaatattttaattctgaatgaacatttgcataataggagaatgatctaaattgcaaacttccattttgaagagttgtagttcttttaaatctttttgtaactgggaagaagaatggaattatgtttgttgtaatccaaggaaagttggttagcattctttcctgttactttttgatcccaaaagaaattctttagtagattaagaccaggaatgaatgtgtggatttttttaaataaaaaattgagagagattgcaactagcaattcagagccagatttatgttcagaaatgtttgatgccagccgttttagttacaaatagctttttcttgactgtacagttgtgttcttatggtaccattctgaaagtgatgtaagagaccatgtaaaatgattggaatgcctcagcatctgaacaatgcacatagccaattattaaaattacccagtactaacctgtcttggcttaggaactatgaaattaactgtgggtagcatttctacacatatcattacagaacaagcataaagacaagcttgtttttttccttttctttggatttgttttttcttattaccatatcttttgttactgaaaactggtggtcatctgtactaatagataagagaagtgtgtttgacaccaatacctaatcttagattatccctgctattttaaaacacagtccttcgcctgcatgctcagacatgtgggttctttcaaacatactggacttcctccttaggttttagttgtgttagtcaatagttgaatgttgaaggagaggatgccaagggatattaaagaaggtaaaagagataagtgacagcaaacattatttatttttaattatctctcagaatgacttttagatacccttccctactaccttttgatttttgctttagcatagctggtgagttttggaatcagagagactgggctctgatttgtactagctaagaatattagacaagccacttaacttctttaagtctcagtacccgtatttatataatgggaataatagtaatatctaacttgcaggattgtttgtaaagattgaaagcaacatatttaattgtgcttgcgtggttctgggcacagaataggcacccgagtgtaggggcccctgaactttaaagttcattactttcatggtaattcctcctttggaatatatagcctgggaacatttgtctctagaccttgtttcagtttcttttaatgactccctttaggctctgcttcatggccaatgcaagattatggatcacctaaagagtagactaaaagtactattgtctagtaacttcaagtttgtaggttaactcactgtgaatcaaaagcttttaaaaatcttttgtgtggtcatagtttgtagtgtcttgtacctctcatctcagaagcaattgattcatagaaaaaattatttaggatttcagattaaagatgaagaactctttcaataagaaggaactgatttggttggattatttgtttctttcacccctgagttttcatggaaatcaggtttaaaaggttagaagcagttggttttcagcattgggaaagcttatctgatcaggcatgcgaagtggcctatgtcggatttctgagctaggaaaggctaggggaggttgaggagattattgtacttgtaattcctgagcatggttgagacacaaggagaggattgtggaaattgtttttaaaaaattgttgaagttaatgcattcttgggtggatttgcaaaacagaacaaaacaaaaagttgttgaagttagttacactggtctaacaacgtatacttaccacccccatttgggctggaggaatggatctaataataatataggtgtttgtgatctaatttgaatcatgtaatcatttatcatttctgggttagatggtaaggattttctgtttcacagatttttagactgggaattgtgctattataaaataatattttacattaaataatgctatctaggttgtaatcaccttaatagacatgatttatttgggccacaaatgaactctggtaagaatggagggctggttacattattttagttttacagatgaaaataatcagtctcaaatagcttaagggaattcctttagaccatatggttagtatatggaaaagccagagctagaacccaggttctgatttccagagcagttcttatttcatgataccgcataattttataatgtccctaaatccgaatttcatttctcatgatgtgaaaggattctctttatttctgtttggttagctgcatcagagcatgacagaaatggagcagaatttgagtattctttccccagatgggtcagttagcttttcttaaagctattctgtgcttacattgttaatcagttgtccctggttcctagacaggatgttgatacatgtgaaataggcaggaatatgtgtctgactcagcttaactcatcacaactttcatatgtcctgctagtgggtctataacgtcaccctcgtttacaggcgtttttaattttctgatgtctatttcttagtatttttcctcagccatttttaatgtctcaagccatagttcttcctgagtggcctgaagtgattttgctgctctttaaagcttccttaaggtttttcaagagcgtacaacataggctgcttctaagtgtatttttatttcctagctcttagcatttctcaccttatcattataactttaaatttaaacagaatacaaattgtgtacacagatggtgtgtcactattgcactgtcacttatgtaagtgcagtttagcatttcttctttccttttaatcaaaatgaggaaatagaaaatgttttgttatggtagttttacacatacacccacaaggaaatgtgtatctagagtctgtgggaactgtgactgatacatttcagggaataaaatgtatgatggctaaaattttaactctgccaaatgttcacggggaaagaaaaattaacaaactcacattttacactttattttagcctagtctctgccttgtttacatctatatgataatgaagctatacttgtctttccacaacagtgtattttataagttgtaccttttgtttaagggagccttcttaacaaactttctttcagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttgacacttttatgttgtgagagctgagattcaccattctccaccatcctgagaagagctttgatagaagggctactcgtgaggtacatagattatctaaaatacatacaattttttcatagaaaattatatatgtattataatttttattcacgacaggttgaaattaatagatttcttacattcactgcattaaaggaatatttatggctttggtaatattttaaatttcaaattaaaaaatttgaatatctgaattaagtatctctgatttaactctgtgtgtgtgtgcgtgtgtgtgtgtgtgtgtgtgttgggaggaggaatagaccttggaattgttttttcaaaactttttttataatagtgcctaatctcagttggcaaggaatagctgtccagaatgctgcatagatctagtgaaaagatttagggaagttgtaactagtttaataaccatctgtggagtgacatagattgacacacccaattacacaagacctgagtctgagaactgttgatgtgcaatcatcccatcagcatctgctcgtcattatcaacaacaataatggctcaactatttctttgaggccacatgaaaagacagtgtacccatagcaaaggataagtcagacctgaaaaaaacatagccctctgcatccccttgttcccaaacttctttttaaacataaccttttgtgaagttctgaaagaattcattttatgttttctttttattaatttttcttcttaaataccatgtctttctggctgaaatccttgccaaaaccaggaagggccagtgtactgtgggtgatttttctaattcatttctttgtcatttgaagccttctgtggcttcatgctgctttatgtgtgtgtaaatattcagtatcttttctagtttacacttttgtcacaactgctattaagccacctatggacacattctaatataaattattttggccactgtgagtgggagggaaagaatcagttcacagggataaatttgcatgttgagaagataatatataatagtttgcaaaacacttctatgtacattgtatcttttatagagacaaggccatgtttttatttgtggagactgagacagagaccccatgagatctaatgcagagtcacatgactccaaagccaggtcttctatctgctctttggtatataactggatcattattctattgacagaaataaggaatcttcttatttttcaaaggcacccttttgcccttggaaggtatatttagaaatcctttaccagactagaaagaagacagttatattttcctgccttttgataaaaaacagtgtgttttttctaaatcttgttgtgtttgactagagtctgattaaggtaccttttgggaaattaaggttctatagaaattactgggctcaatctagtgatacaaatatgtgttgtttgatttatcaacacattacaaaccttaactttggagttttaatatctggttatctttaatatctggttatcttctttctgaagtgtatgtacacaaaattgatgctaaataaggtcttgttgttttggcaaatagtgaaatgcaaggtattggtagatcagtactgttataactttggtgcaaagttgctgcatgcagattggctgtgggaccttgttcattttttgagaactaatgtagagtttgaaaaaacaccgtaagcctgcattccagaagttctggtatggatagtgtgagcccagggaatgtgcttagataaaagatcatttaacaaataggttttgcatttttttagcaatcaggctttgtgctgaatattagagtggttgtttcagagagtttgcagcaattaggctttattggtgcactaaggagaagcagagaggagaagcaattcttggtaacttccttggaagttgcagctaactctgaaaagtctgggttgaactaggtaagtaactaattcctagaatcaataaactttgcaggagtccgtttgattgtacatgtagctccctggaattgctattggtccctaaatcatcagtttgtaatgctggttttcaaacttgagtgcacatcaagttttggaggacttgttagaatacagattgctgggctcacccccagagtttctgatctggtaggtctggagcgggacctggtagattgcatttctaaaaagcatccaggtaatactgctgctgtttgggaaagtacactttgagagtcactggcttacagcaatctcaaggtgtttggatttttgggcaggggtgctgtgcaggcgttgctgggatctcttcacagcacctccactgcatagaggtgagcctccagatgttttcattcattcaacaaatatatgtacctattgtgtgctgggcactgcttaagttgcgaggggatattgtgaagaaagtaagcaaaacccctttgtttgtagaatttcagtgagcatagtcctgggttaacctgacaacagtcctactgtttattgatgcttataggtgagcctatttctctttctagctttcttccacttaatttactttcttttggaattcttgaatttaataataataatattgatgttattagtcatcactataactttttattgagtatgtattttatgtcagacacagtgtggctaagtgctttacatacattatctcatctaatccttagaaaaaaccctggtgtattagtcttaatttaaaagatgtactttggaaaggttagtagtttacccaagattatgcagctagttaaaagtggtgctggggctgggcttggtggctcacacctgtaatcgcagtgctttgggagtctgaggcaggaggatcgcttgacaccaggagtttgagactaacctgggaaacatagcaagaccccatctttacaaaaaataaaaaaattagccaggagtgggggtgcacacctgtggtcccagctacttgggaggctgaggcaggaggattgcttgagccccagaggttgaggctgcagtgagccatgattatgccactgcacatctgtctgggtgacagagcaagatcctgtctccaaaaaaaaaaaaaaaaaaaaaaaaaaaaaaaaaaaaaaaaaaaagtggtattgggcctgtctaattgcaaagccacattctttactgcatgctttagtccattgttttttaaactgcagatcatgaccacgaatgggtcatgaaaccaatttggtaggtctccaacagcactttgggggaaaaaggggtagaatagagagtatcacatagtatggacaagcattgtttcttgaaatttttgtttttgctatgcacgtatatatgtgaatattgaggtctggtacaagatatatttctcactgtaggtcacagtaaaacatgttggtaagctactattttcttggctatgggactatatgtcatctaatcactttttaaaaacagattacaaactgtaggccttagaaaggtaagtaatttttcagctgggcatggtggctcatgcctgtaatcccagaactttgggaggccaaggcaggcggatcacgagatcaggagttcaagaccatcctggccaatgtggcaaaaccccgtctctactgaaaaaaatgcaaaaattagctggacatggtggcgtgcacctgtaatcccagctactcaggaggctgaggcaggagaatcgcttgaacctgggaggaggaggctgccatgagctgagatcacgccattgcactccaacctgggcaatagagagagactgcatctcaaaaaaaaaaaaaaaacaccaaggtaaagtaatttttcaagagcacaaaaatagtcagtggcagtacaaagacaagatgactgacttttttttttttttttgagacagggcctcactctgtcacccagactggagggcagtggtgcgatgttggcttaccacaacctccacctcccaggctcaagcgattctcctgccttagcctcccgagtagccgggattactggggtgtgccactaccacccggctaatttttttgtatttttagtagagacgtggtttcaccatgttggccaggctggttttgaactgctgacctcaaatgatccacctgcctcagcctcccagagtgctgggattacaggtgttagccactgtgccaggccagatgtctgactttttagcccttggtccattgctttattcttcacaccataccacttccttagaagtgcacctgggaatgcctgggaattgaattttatctttccacatgatggcagatatgctatggaaccttcagggatgtcggtgaaacctgaaaagggaagttgaatctcagcctgctctgagtaggtgaaaattctgccttggatcccccaaagtctgcagataaagatgtgacatttctcgtgttctgctgtgcttgaaggaaagagggtaataatcttaacagtgccaagctgtaagcatgttgcatatattaacttgtttaattactaattattttgatacagcggccatgcctgggatatgaactcagctgttttgagtgagaaggggcatcctaccagtgtgagttaacacttctctgtactctccccggttcctcattttgttcctgctgagttcagagctatgttcctcatagcctggcttacctgtggatgttctcagcctcattttcttttgctagatcatatatcttcattaggtgggtgattttggtttctgttactttttccttaatattagtatattgctgatttggatcaggggccaggctgtagattttcagcatggtgaggtgataatacatgttggtcccccatgcagaatgctgcctctagcactttagccaaaggagctctacagtctgtccagaagtactgggggacactggtaataacctgagaacacttacagagccttccagaaagtgccctttcacatcatataaacagatcatgggaagctgagggaatgcaaagtcaaggcctcattggagagcggaaaggaggctgagattggtggagaggagtggctgttacattctaattagaagaatgacatgtgcagggccatgaagcaactaaagatgggatgaaaaacttaacttgtgaatcgcaaaatttgagtaggaaggagctggaaaggcctggaagtgcgaagtgattggcccttggtcagatggctagaagatagagagccaggcatagaacccagaatccaggccatcattttgtggcctcttttatcctaatgacgttagccagaggtgtcttccaaagcacctgattatagggaagaatgaatgtcacttaccctagagtgagtgaaatagagatgccaggaagatataccaggtttatccagtttctttgcatttttctggcatactgtatactcttgagcgcatatgtatcctactttgtgaaatctgggggtaaagcaggacccttcaaacccttaaaaaatgtataccccaagaaaaacatttttaaagcatgaacgcttcctcaagtaaatacatatttatacattatataaatgtctggctattaaaccatgtatgcatatgttaactctaagtaaagcttattatatgttttttagcccataaatatggagatgttttaaaatttcttccagtgccccagtggatgatcttacacctcccgtgcttctgggatacacacatctaattttgcagaccactggtccagaatgtaaattgaagagtttaatgtctaagatatttgttcttttgtttgtagcttatcttttactccccacgtttcaaatatccgtttgcaaaataatttttgagttaaaattttcaattaaaaaactgtatccttgaggtagaaaagataaagatagaagatatatgtgaattaggttgtatctctccttaagagggaatactgttttttatctaaggagaactaacaaccctccctttcattgtctgggttggtataagtaaaaatccttgtttgaagttattaagccttcccacccatatgatgattagtttggttcataagctagagttagggcttggtaaaggctcctttttttttttttttttttttttaaagtctttccaccttaactagcaagtaagctagaaatgacagagcagtagaagggggaatctaccagagtgtcctacaggaccttgttgaatgctactgctgcatgcaagggttgtggatttggtgtgggccttctgcagtatcacccaaatttgagcagtacatgtaactaaaagtaagaaaaataaattagacagtttatttcatttcagactttggaagcccaggactgtggggattagctattagctaagacaatgattcactgagcaaatgcagtgaaagattcttttgttacactgatcatcatttgtggagagactctgaagaaggataaagctctggctgcatagtcaaaccagacctactactcaaggacatgcatactagatatgtaggtgtttccaaatatttttttcagttgtgggggtgcaaatcatttcaatagtagagtaactcagttcattactgttactggaaaaacaagtttaaccaagcacatatcctactgagggtgagtcaacagtgtcattttaacataagaaggacagtacatgaagtgagttattccaagtcctgtggttttcctacagctgagcaaagacagctgttctttcggaagtggggctctaaaaagaagttgcccatctcctttctttcttgattatagccttttagttttcttttggcctgagacatttcaaaaattcacttcctccttagatttctatcaccaaataccctgaattttgataatttatttatagagtatattatttattatagacttattatagtttaaaactttattttaatttatctcccatttcaagatccacgtttgctatatgtgtcagataataaaaatgccataaggaaaacagaggagtgatcttttttaatatgtcattattttctatagttctttagtggtatggacatggaataaggtggcattttgtgggacagtataccaaacttagtgataaaatttatacttttaattttggaggacaaaagtcttgtattctcagccttgtggataagacagtgctctgagctgtctgaggtttcctaaattgggattcaacatcatgaagggtatgtgtctggatagtttatttgttggtttgggaaggtgagtttttgtcttttttccccctctgagttgatttctttagttggagagaagcagaccagatgaagaaaatactttatctcttatggcatttttggtttaccacattagtgatgacccgtcttctctgagcagcaggccatgcttctctgttcagtagttcagttttcactaacttaactgcagatgtgttcttggagggatttatttctaagcaattgaattatgggtacttggataaaatgatgatgggttacctacttttaatagggccatcatttttaagagtaaaatcttgtcaagatagggtatatcatacttatgatctggttccatctctaactccataatttccttgtgctcctgtgttgctactctattattgagaagagatggtatcttgtcagtgtcaattttacaaagaaaaaattctaaacaatttcagtcatagggtagtttttttttttttcctggagaaataatgcatagtgtagtatgttgaatcctagagttggcaggttttcaaaagtggggttcttttgttgtgtaggtaggggtgatgctagtcaatgggtgttagtcattagggcatgtgtatgagtggtagttctgagatacagcattggcagcccctcttgtccctggttttgtttttgataagcaagtcctggttttgttttaataagcaggtcattagctgatctttcgtgtaaatgtttttgatgtgcatagctggtatgtgggtggttacctacctgagaatgttgtagtcacaaatgtatattatggaagtttgcagattatggtggatatcaggtttttctaactgcgtatttacagatgtagtgagtgaaaggaatgttgggtcagtaggtaaaagacttgtgctctggtcctggttcagacatcttgatttgtgtgactttgggcaagccccttatttctttgagttgcagtttcttgtgtaaaatggtgctaataccaatttacatgcctcatagtgttgttgtggggatcaaatgagatcactgtttatgagcagccttctcaggagtgagaaatagagggttgtgagctgactttctgatttgtttggctgaggtgttcacacaagccatagaatgctttgtaggcttgggtggaggaatgtagatggaaatcagctgaaaatccctgcctattagaagctgagatgttaatcctaaatatattctatggagtactatcagatgccttgcttttcttcatgatgccctattagcttcatcttcaggtagcataggtgcctgttactctcattttacttgaagaaactgaccagccaactgatttaggatatggctggctatcttctggaactcacattagagttactccttgagagtaaagtcttgtattttctgaaggttgctgcttttggggtattttccgtggaggtgggtgggcacacacaaaaactcactgtgctcaaatttataaacttgttcttcttaacaattttaaagccagattacattggattgggggaggggaggatactagatttagtgttttttaatataaaactttgtatttgaaactttatgtggtaacatatatttaggctcatagccaaagtgattacaatgcattggttttaatattttcagtgaggtaatgtgtgctttagtggggaggaggagaaatattatttaatcaccagcactacactaataaccacatttactaaatcctttgtccctttgcttgaactgagggttccttgcttttatactggttttccaaaggacttaatcttgttaatgtgatgaggtgatgatgggaaggacattcccactgggcccgaagtggtgaaactggtaaaactccctttgtaagtccctcttgttcaacatgagtgtcactcccatgtccctaaagtagaatggagttttattgaagagagaattttaagagtgataaacaaaagagatggaaatatctcctgtgccaggtcattgttaccattaaagactagaataaactgtaattttgcagattttctttttgtcttatgggaaattaaagacttggttatcctctctcggaggaagatagaaaactactgggcctgctcattaacagtttagcttggctgacatttttcaagcacttaccatggtattatagctgggctgaagctaggtggagcagacctcacttaggtgttgcctagctccagaatctgtcttctggtggaattcccttaggcttccagacaggagtggcaacaaagcagatgaaatggaaggtaggccagggcatctgctcgttcgctcgctcgcttgctctttctctctttcccttttctttcctttcctttcctttctctctctcctttctttcttttgcttccttcctctctctttccctttcccttcctctctctcttttctttttttctttcttttttttcttttcttttctttcttttctctctctctctttctttagcagtttattactcatttgtgagaatcagggaagcactgggctcaagaaagccaataccccttctagggcttaccccccattttaaaatttaatatattggaatttatattgtttcttttgatccgagatcttcaggctgaagctggagagaaatcttttgacctctctagaacaaagaaagcctttatcaaagacaatgtaactttttgagtttgccaaattaggtgttgctgcaaatggagaaacctagagttctcttctgtgcttaaagacacaaacatggaaagttttaagttccaatatggtcacttaatatatacaaaattttctgtctttgctgtctttgtcattccagcaacaactggatgagcaaatagaatgattgtgagcacttgcaaaccaaattgtgactgttagtgtgttgagctgcttttttattaaaatgactgctacaactctgcagaaatctgagtagtcttgaagataaattcttgcttgcatttacaataaagaaagaatatgagtaatcaaaaggctgatggagttggaggactggcgtttttaagaggaactgatttggacattgagattatcagctcctcatcaaatatcattaagtacacattattatttttttctgttgaccaggagacccaagttgtgttgatgtgggacatagttgtatgtctgaagaaacaaagcaagggagaataaaataaataaaaattgaagttcaggaatatatatatatatatatatatttttttttttttttttctcaggcagagtcttgctgtgtcgcccaggctggagtgcagtggcacaatctcggctcattgcaagctccgcctcccgggttcatgccattctcctgcctcagactccctagtagctgggactacaggcacccgccaccatgcccagctaattttttttttgtacttttagtagagatggggtttcaccgtgttagccaggatggtctcgatctcctgacctcgtgatccgcccacctcggcctcccaaagtgctgggattaaagacatgagccaccgcgcctggccgtttagggctatattttatgttttcttctccctttggtatttaataaagatttgatatttttctattatctgctttcctctgttccaaggtttttggcctcaggtgtgttctctggaaatggcaatgataggcatttataatctccatatttagatatttccctcacagtgctagtttctgagcttattagaacctaatgttaaatgacgagttaatgggtgcagcacaccaacatggcacatgtatacatatgtaacaaacctgcacgttgtgcacatgtaccctaaaacttaaagtataataataaaaaaaaagaaatatcctggctatgagtcaagggtttaggaccttttgaggcacttgggtttagacaattctcagtgatgtgtacaggaatttgggtacaggaatactattcacaggtgaacagagtttgattttggctgaaggcatattatttgatccagataataatataaaaataatccaaatgttaggaccttagcttctgcgaaccctgacttgagaatagttagccatacatgtagttggactttatgtaggactaaccaatctcctctgcactatttttgcacagtacattgattatggtatccctgatgacctctgtccccatccttgtgagtagccttcattgctaccacccaaggatgttttaaaaaggctatgaggaaggatgcatgtagggaaatctgaggttgttctttggattttccctgttttgttttaggaagtatccatgattttatataataatatgtagcaatcttaggtttttccattttcatttttaacataattttgttattcattctgtttgggtgtctacctctaaattaacaaacatgagaaattgtgtactccatttaaaaagtgtcctgagcaatttaagctaaaagaatatgttgtttcttttgtgtgtatagcaagaagattatatatatttataaatttttttccagcaagtgtacttaaaagcatgtacttaaaattaaggacttaaaaaaactaagctgtacttaacaaaataatctttagaaagctttaaggccgggcgcggtggctcacgcctgtaatcccagcatcacgaggtcaggagatccagaccatcctggctaacacggtgaaaccctgtctctactaaaaatacaaaaaaaattagccggttgtggtggcgggcacctatagtcccagctactcgggaggctgaggcaggagaatggcgtgaacccaggaggaggagcttgcagtgagctgagattgcgccactgcactccagcctgggtgacagagcgagactccatctcaaaaaaaaaaaaaaaaaagctttaaaaagggagtttactaaaagcacaggaaattggtgacaggcaaaatttgtcttgataatagtacaaatacagatagtggaacagaacagataatacaagatataagacaagacatggaataacacttcatattcactttctttgaccactaagcagcacacaaatatatagcactttttgtagagaataattaaatttctagatatgatacagcttcttcctctctgttgggttttattacactgagatcctgaaccttttggacatgtaaactgtgatcatgttggtcagtgtcatttggatctcgttggtgcttattgttctgccgatgtgtattagtgaacctactcatggggaagataatactatacaatgaattttcccattcagttggaatttttttattactctgttttctatgtttttcatttagatgtaaattattttggcttccattcaacctatttcagctagtttttaccataatacacatggcttaagatttataggaggctaagagtggagagtgtatcttcattcaaacaaatggtaagaaaggaactttcaaaactgttttagttttgcaaagattagaaaagtacaattctactttctcaacttttcatccttgttaaaggcctggaaatttgcagcatttttttctttcttattttacttttctaatttgttacacaaagtgaaattccacacataaacatgcaagctgaaggttgggtttattcataggttttgtcttaattatagatatttagtttattgaatatcttattgagtattgagtacctgctgtggtccaggcatcttcttaggtcccaggtgtacaaagaggagccaattgtggttactgcctctatggaatttgcctagaagtgggagagagagagatgagtgagccagcacttataatacatctacctaggataaaatgggagcacagaagaggaacatctgtatcagtgggtctctgagagcttcttcaggaaaataatgctttatctgtgatttgaaatatagtaggaatttagcaagatagagaaaaaggaaaaggaggtaaaatatttttcaggtaaaagaatgtacatgggtatagaggtgatcattattagcaaattggctacatcctaatttgtaagtatttgtggatttttcaaaccttatatttcatgtagaagagctgaatgcattagtctcatctccaagatccaggtattgaaatttaacccatgcataaattgaatttttttctgaagtctttaataagagaaaaataaaaggaaaaactacacagtgtatagtagatttcaatatagcacagcaaacactgatgaattttttttgcaatgagttcaatattataaaatagaacaaaattggaatttttaaaaccaaaaattattctagatttatcagctaactggaatgatttttttatagtatgaaaagtctgttagtaatacaaaaaatattcatttataagttgttatcgttgattatattttcttaaggtatattttcagtttttgaaaagcagtaataatttgctatgaccctatagcccagttcttaatatctggatctgatactagcatctcttaggtagaaaacacactttctatatgataatatctgtaaagagcacataaatccttggaacactattaggaaaacaaaatcgatttatctcttattgcttttttttggtttttttttttccttttaatcaagacaaatttcaaggaggaagacatgtttctccgcttcgtttttatttaaatgtaccacttgggatttgaagcttccgcacttcttctgtttgtttggatttttttttcatggcttggtcccaaaaaatggaatacaaaatttagagaaagttttgtttgaaattgcagggcgctatgagaattattgcaaatccctgatgtctctttgtctgccctcaattctcctatttttggtaataatgcaggcagtcattttagaaaactttgctttgttcattttactgagcctcttccagaggccatgtgccagaatcaacagcagccaaccacagccaagatcctagggcgtaaactcagacttcatctctcaaatattgctacttgaaatttgcataaacattgaagaaaaagttaaaagagcctgtataactcctcttcatgtattttaggagcctcagacagtcaagacattaaaataccttccgattgagcagtgggtctaagcacagataccacactgcagatagggagaaggatatgaaaaaaatcatgtgagatagacgacagaggcttatttgaagaagctacaaagcaacaagtaatgccagtttaaaacgattacatgttaatgcaacaagtaaaacacattgaaggctgctcagattacactggctgaagtacagacttaattactcatgttagagattcctaaaacaaagggaggcttttaagccagtgatatgtagctggtatgatattgaaaagcattggaaaacctaggtaaatgcctagaggaaattttaaggaagagtccatcaagtctggataccttagccttatccttaaatgaataaatttctgaggcgctggaactggttaaaatcaatggcagcttgttctgttgttggcagttttgatgtataattggggctgataaacctgaataaataaaagagccttgtctggattgagttacagttagtgctaaacatcaagggttcctattgtatttcttaaaagttctttttggagtgattccaagattggtattaagagggtatgccaagggtatatattggcaatttttattttgtttgtatttatcttagagtcatttgggtaggtcacattctctctgcccctactcccaacttctcattagattgtaaggaccatgaggacagagattgtttgttttatttgtgcttagttttcatgcagtgcctagtaggggacaatgctgacagtagtttctcgacaaatattagtggaactgtattaaaattgagtttttgctcacatatattgtttattttacctttagtggatcacttctccttatgccttcagtgctatagttttttaaaagaagtatgttagtctgttttgcattgctctaaaggaatacctgaggctgaataatttataaagaaaaaaggtttatttggctaatagctttgcagattgtacaagaagtttagagccaacatctgcttctggtgagggcccaaaaaactttcgtggctgaaggtgaagagggagcaggtatgtaacatggcaagagaggagggagcaagagagatgtcagtctctttcaaacaaccagctcacatggtagcgagaactcactcattactgtgggtgggcaccaagctattcatgagagatctgcccccataacctgaacacctcccagtaggccccaccttcaacattggggattatgtttcaacgtgagatttggaagggacaaaatagccaaactgtatcaagcacaaagaagatacagagatagtcaatggtggagctagtattcaaacccagatttgtctgatttctgcatccatgctttcaactgcttaactgcattgcttccaatactcagaaaagacgaaatgttttccatatcccaggaacttaaaagtgaaaaagcagagagctagaagaccctgtagtgctgaattgagagtcatgagtgttacaaggatgggtgggggggtggccctgtgaggaccagaaccctccaggggaagctttctgggtgaggcaagaggtgaactgggccttgaaggaatgggtagaatttagatagtaatgaggaaggcagaaatcagtggaagcacagacatgcatggaggaatggaactgagttcaatgacgatctgttcaggaaagagggcataaactgggcagagaatgcagtggaagtggtggggagtaatactgggcacgtaaggtaagctctgatctggaaggccagcatgggagcctagactggttaaagtaagaaatggcttgtccttggaagaaaaagtgtcaaacttggtactgtgtgaaggtactgcacagacctcccaactggttcttaggagagccaaactgaggctaagttctgagaactaagtaagaactgacagccattgtaggttagaaagtagtggggcaacatgttacaagtagtgcttctggaaggttagatgcggttagaataaaatcattgccattttggggagctgggaaaatggatgtcttcagtctagtctaaaaagggatgacttgaataagcttatataagaaagaaaagaaaaacctttttactcactggaccatttcataatcttgacttttttcaaacataaatctgtgtcatttttcttatttaaaacagctgagcagtttactctcctacttagagctgtgatccttatcatgggctcttgtgatctaaccccagcctgcctccctggcctctgtccttgcttaataacctctagccatatgaacctggaataccagtctaattcccacttcaaggcttttacacttgttgtttcctctgcctggggtgctattccctcatatcttcatgacacttgttcatttacattgtagctcaaagcatacctcctcagggaggcctttcctagacactatctgaggtacactcctgcacccccagccttcatgattgctttttatacattactgggttttgtttccaatggaacttatcgcttattactgtcctaaattattttatttattaattttttagccacctttctcttatagaaataaggttcctgaggacagggagtttattctgtatactacggtatccctgacatcagggcttgtgcctgccgatagtagatgctttctaaatatgttctgaatattagatagctagttcccaaatgcactgcactgaaagtgtatgaaaattggaaattggcttctagatttttgtattatattgccaaatgatggagtgatgagattgaaatctactacttctttttgccttttttttttttttttttttggtggagtagaggagggcctgcacaaacagcagatacacacacagtaaataagatttatttcagccagcaagtatttattgacatgaaaattggggttaaatgtgactctttgtgagtgactagtttcttggagtctattaaagcatcagtttaaacatcaattctctatggtatgattaatgtttctttttttactttataagcatgaagctgccttcaattttattgttaaatttaagtgttttacattggaaaaaagtaaattgaattttgaaatgaggtctgtcccggtctcactttcatggcttcaggttatcaaagttttaatttctctttgtatggaagataattatagtattcatttttgctcctgagtaaagccacgagtctcaagattatttttcttttttaaaaattagaattgtcagtttatagttgtatacatttatagggtacaaagtgatgttataatttgctaatacaatgtagaacaattaaaaggtagttagtatatcctttatctcaaatatttaacattttttgaaatttactctcttagcaattttgaaatgtataataccctattattaactatattcaccacactatgcaatatatctcaaacatatacaaaaaaattcttcttgtgtaactgtagctttttgtacccattgatcatcaggcccacagcttccgtaaccaccattttcctctctgcttctatgattttgatggttttcaattctacatataagtgagaacatgctgtatttgtcttcctgtgccttatttcacttagcataatgttctccaattctatccatgttgtctcaaatgacagaatttatatctaaaggtggaatagtattccattttatgtatctaccacagctttttttttttttttttttttttttttgagatggagtctctctctgtcactcaggctggagtgcagtggagcaatctcggctcactgcaacctccgccccccaggttcaagtgattctcctgcctcagcctcctgagtagctgcgattactggcgtgctgtaatttttgtacttttagtagagatggggtttcatcatcttggccaggctggtcttgaactcctgacctcgtgatccacccacctcagccgcccaaagtgctgggattataggcgtgagccactgtgcccggcctatctaccaccttttatttatccattcatctgttgatggacacttccataacttggtatgggtgtacagacatcttttcaataaactgatttaaaatatctggggtaaatacgcagcagtgggattaccagatcatgtggtgattctattttcagttttttgaggaacgtctgcactgtttttcacaatggttgtactaatttacattcccattaacagagtagaagggttccatttctccacatcctgtttattcagacgatatgttatcatctaaatcatctaagacctctatattatatagcttttgagtatttttaaaagtggacactcaagcgttcatatagtcatagtcagtgtgtggttcctcagacctgtggtatcaacatcacctgggaatttgttaggaatgcagattcccaggctccctgcagacttagtcagaaattgtgggggtcgagtctaacactcttttttaaaaagccctccaagtgattccagtgcttactaaagtttgagaaccgtggctcagtaaatgctaaaggttcaaggtagcatgatcccacacatcagccaagtggcattaattattagcctggtaagcccaccttcttttcagtcactgagtttgattggttcactagggctaggctgtaaagttatttgctagattgattgctacatattgactttgggttgtttgtatttctctgaacctgtcactgtaatgatttgtcaggacacttaataggaacaggccgtgatttttgcacccatggcattctgagtcatgggtggctgggtcattatgtactccaggtttcttcaggcactgggcatgccattcatgtacttataaggagggagctgtcgctggtggatcacagggaacctttagggacatttagttcgctctcagcttggtacaggtagggaaattgagcccccatgaagttgtgctttgcttgcagttaggggtacagacaggatttcaggtctcctgagtccctccactgcaccaggattcctgcagggggacagagctacagctttttctgtgcctacaggacattcctttcctactgtgagggttttatttatttattattttatttaaagaaaaaaagtaaatagaaaaaaccccggaagttctcactgaaactaataaaagtgtctaaagagaatgaaaaaatcagtttgagaactttggtatggaggaaataacctgacattaactgttttaattatagttgttgcattgggcttatcagtgtgggaagagggagcatttgagccttacagggaagtgggatatggacaacaagatgaccctcttcctgaatttgcctgtttgggcctgcagcctggtgactctttgtgtgatcccaacagctgtcatagagatgggttggacttttactgagacctgggtcctaggcccagcactgccaccagctagtggcgcgatgccccataaagaggccacttattctctctggcctctactattggtaaatgggtataataatatccaccctgccaatcctgagaaatttcaggtagtgggaagcagtgtatcttggtggttaagggcagagtctctggattcaaattctagctttctaactcactggcatggcagtaggcaggccacttatcctccctgttttctcacctgagaatgggtataatgaaatttacttctaagggttgttgtgaagattgaattagttagctaatttatgtaaagtacttaggatagtgccggtatttagtaagttctatgtgttagcctattattattactattaccatttaaaaatactatttcaaggatgggatgcattttctgtaaacatgttctcaaatgattctactactggatacaatactgggcttttatgcagtaattgttgttggaggagttgttctgacatccagcttgcacctgggctactggtttcgtggccagggatggccaggcctagcgtctctgatcttgcacaatttatgcatagagtggtgtggttagaggaaacttggaggggggaacttctcagttttgctttcaggtatttatacattaactatcataagagatggacatcttaataacttccaagaaagagttcatgagcttcaatttgatatttattgtttgactaggtttctttctgtcttacctttccagttgttagggttcttgatatgtattttggtgatgaaaatttcaactctaaaagctaaacaatcaagatattgtaattatccagcaagtgattagcagatttcgagtagacttcttccattcttggctgaaatcaatgaaaatgtctactattgctgttgtttttgttcttttctctgaaaagtctgtttttgggagggcctgagatggtaaagtgcctttttattgtctcttaaagggaatgggggaatcaacagtttgagaatttttgttttatctgtatgtataaaattgccttctccttttatttcttttgatactctctctgcagtctctattcatgatctactccccatctttttatgggccccttaaagctagagattatgtttattcgtttatttatgtattccatttctccttttttctggatcctaattttgtgcctggtgcatactaggctctcaattttagtttgtcgaattactgttattgctgtttctgattacttcttgaagcggtctgttttaaaacttcacctgaaggctaagtaattcatcagtataatggtgatctattatttatctagcattttcctaaacactcattgatgaatccttataatactcatctgaagtatctaaatcccaagatgatgtgtcatgtcatagatggtatggctttaatttttaattgggagatggagatgtaacagctggagatactgaaacacagagaaataagagcatgattcaagaccacaaacgtggttattgttggaagatagttttgggatgggcttctgtgctagaagccaaaacataaaaaactgattaaaactctaaaaagaaacccagattaggtgggaatgaatgctgatctggattggattacacttctttggtgtctgagggttatgattagtgacttacttctaatgtgcatttgtttttatttttagcattgcagtgtcgagatggctatgaaccctgtgtaaatgaaggaatgtgtgttacctaccacaatggcacaggatactgcaagtaagtttttctcttcatatattttctttttgcgatagaacactggacaagatttgattctactcctctatttttaatgcttctgtggaatgttactggttcttgagctttcctggtacagattttggttgggggtgaggatggaaggatgtggatgccagataattggctaataagaacttcttactatcttactgttatctttctcactatgaaaaagacttttcagtgagtggctagttaatgtatatggggtagaccaggcatggtggctcatgctggtaatcccagcacttcaggaggctgagttgggcgaatcacgaggtcaggagttcaagaccagcctggccaacatagtgaaaccctatctctactaaaaatacaaaaattagccgggtgtggtggcgcatgcctggagtcccagctactcgggaggctgaggcaggagaatgacttgaacccaggaggcggaggttgcagtgagctgagaccacatcattgcactctagcctgggtgacagagcaagactccgtctcaaaaagaaataaaaaaaaataaaaaaatgtatattagattcccttgtgtttttcagattaaggaatactcttagagtctccccttaacatgttacctattatcttgtttttaagtaaaaccaaatagatatcaactttaatattcggcccagtatatgtgaatattatattcatatttttttctagtgtaaaaaatctaattctgaaagtgagacagtgagagaggaagatgtgtgcatatgtgtagattgagggggagcaggggctttgggtgtgtattattatatggggataaaagagtaaggatgaaggaaaatgtaggctagttcttggcttaagagcatttttttttcctttttctccaaccatctactctagccaagacgttttgtttgtttgaggaaggctgtgagataatttcataatagcttttctatgtttcctgcaaataattttttttcttctgcctcaattgaaaatttttaagaggaatatgtatccattctgtttatttcagggaagatgctggagaaataaaatttggtaatatgaaatttctcttcttttccttcatttttgtgaggagtagttcttctttgctttggtggaggtacttgcttagtaagcattttaagtgagtttatccaacacatttttatttcttaccaggaatgtaattacaacttttttccagtgagatctgttctgacaccaggatttagttttttaatgttataaacaagatttttttttcaagtcagaaataattttcttcactaaagtgaaaattaagctgtgatgacagtaaagcttaacaataggttgtttggattggaataaagataacattggaaataaaggttttatgtagcttattatgggctgctcatttagtttttctagctgggggaaaaaaaaatgtggtgcattctcctctaagaatggagatacaactggagataataagggagggaacttaataccttagagtaggccactgaaatcttgtttagtctttttgtggcatttggtgcgttagttgcttgctttattctgttatgcaactcttgtggtagttaaccccattgcattatggtcatttgttgatgtgtttcttttgctagaatgtgaggtcttagtcttatgcattttttgcatagttaatgcctagtacagtgcctggtgtagttattgttcagcaatgtgtttcttaaactaaaaggtgctaagtagataccgtcatgcacatgtttcttatctatttatgttaaataagaagacactggttctctcctttaaaaatttcagtgtggcgattcctcaaggatctagaaccagaaataccatttggcccagcaatcctattactgagtatatacccaaaggattataaatcattctactataaggacacatgcacatgtgtgtttacttcagcactatttacagtaggaaagacttggaaccaacccaaatgcccaacggtgatagactggataaagaaaatgtggcatgtatacacgatggaatagtatgcagccataaaaaagaatgagttaatgtcctttgcagggacatggatgaagctggaagccatcattctcagcaaactaacacaggaacagaaaaccaaacacggcatgttctcactcataagtgggagttgaacaatgagaacacatggacacagggaggggaacatcacacactggagcctgtcagggggtggggggaaaggggagggagagcattaggatgaatacctaatgcacgtggggcttaaaacctggatgacgggttgataggtgcagcaaaccaccatggcacatgtatgcctatgaaacaaacctgcacattctgcacatgtatcccaaaacttaaaagcaaaattaaaaaaaaatttatttatttcacatagcattcagggtggtaataccatacagagaggcaaattggttctatttgaagatcattcaacttggtgacttatatatggagaatttcaaatatgttctaagtgttcgcctatatatttttggtctgacatggggagagaaggtttctaggggagactaatctctgagcacttaccaggagaggacacctaagggtcactgttgggaagaagtccaatagttctttgttggactgttgggctgctagtctcatactctccaaccaaggttggagaccatcctggctaacacggtgaaatcccatctctactaaaaatgcaaaaaattagctgggcgtggtggcacgcacctgtaatcccagttactcgggaggctgaggcaggagaatggcctgaacccaggaggcggagcttgcagtgagccaagattgcaccactgcactccagcctgagcgacagagcgagactgtgtctccaaaaaaaaaaaaaaagaaaatggagctgcctaaattctgtccctggctacttgttaattgttgataggatggaatgcttatggatacagttctgggtatgtccctcagatgtctttcctgttttgagggaaacaaactccttgagagaaagaaaaaatttggtgaggccatccttttgggagaccaagatgaacaacaaaacttgtataaagagagtgattccctacctcagcaaaagtaatattagcatatttaggagtggcagggtcaacataagtggacaaagaaaaagcaagaacaatatcaaggcagccacgtcaatcattctacagtgctttgccagcctccacagaattttaagcaaaattttatgcaaaaataatgtgtacctagcagagctttcagtgtattttcaccaaccttacctttttttctgtggagaaagaagatgatctagcttgttcagtaaatattattttcacaaaatagaaaatagatattaaaacagaagatttataaaaattctatcaggcatgcagggcatgtgattatctttttattcatgcgattgcttagtggattaagaaaagaaagttgaagccaaattccttttacagggccagcgtgggggtgagtggtgagtggtgggatgggaactggtagaaagtgttttaaaatagaaggaatctgactatctgtttagacagcataatgctactgattcagctaaaatataatgattgtttatagaaattataaaaatccttgataagatcacattgacagatgaagataactacttttgaagattagttttgtactcagctcaactgttttttctcagtgttaggagcctaagtaccctatcagtctgtgattagattttgatgccagattaggagaacttgtataatcttgcataaaactcaattattgctgttaaataactactgtcaaatcttaataaagccctctcactacagggagataagatattttattctttcccttgtcctactgggaggtgtaaatatgtaattaaatttgatgtcattaatcactttcaagttgtttgcttcagattttcaaatataaaccattctaaatcccaatttgattaaagatcatggacaactcaagttcactaggattctgggggtaggttaggttatgatttgtataattgacaaaatatgtattttaaggacatttattgtagttatttaaaatctttgtctgctggttcttaacatctgggttgtctatggatgtgtttctgtttctatcacctgctccttctttggaccatgggtatgacttccctttactttacacatgtatggtagttttacattacttactggacattgtgggtgatagattttaaagtttatctcccactaaagaatgttgaattttgtcaagattggcagatcatcttgatcctatggatgctaggttttaggacacgttagggtgggcctacttctgttctgcccttagtccgatgacacaaatcttagtcatgggatagggctcttattcccaagatgtgacccttctaggggttcagtggaaagtgtgaggggcctaccaagccctgaggtgttcattaagcccctctaaggcagaacttgtcctcccagccccaggagccttctgctcagtcttttcagccgtccagctcttactttctcttgggtttctgaatcttatcttgctcatgcatagtcaggaattatttaaggatttgagcagagttgtatgcatactttgaagctacccactctgtggttctgtcttttccaggaatttttctcctcatattctagctgctgtgacagctccagatacctctgactcctcagtatcgcaggacttccgttttctgcttgcacactcttcctcttctgctgcatgaactggggtgtaccttcacgataaaaaaaaaaacaaaaacaaaactgtaaatgtgggtttcatatagtttgcttcgctttttctgaggcttatatcccttctagtttatgcctgctttcagtgattctccagtgcctttgatattttgtccagagcaagagggctagtctgatatgttactctgcaattatttttaatgatgaaaattggaaatataaaggggcctttcagaatttcatacataccacttggtaaatatctaacatagtgtttgtaaaacagcagaaagtcaccgtgagttgtatacgttcctgtagatgggtgcttgcatttgagaatgtccactttttgctaaagtgctgatctaaaaactacactttaaggtaaattattataaatataaagtgttataaaatataactttgtgtcacattttgtctaaaacttgtctgctagctgtaataaacattaaacattaacagctaacaattctccttgccaggattaggcagtcatgttggtggtccagatttcctgaatccatccaagaaaaactagagccattgccttctttgtcttcttggtaaatgtctgtatagtaagtagagagtagagacactcataatcccttagaacttagctttttatggaggatgcattcgcaatgtttctgttgtggtgcttctcccccaaaaaggcgttttcagaagtcatggctgactcagcatttccccctttccttcaccttcttgtgagtgcattcagggaggcacaggggcattgtcagatcaaagaaatagacagggaaaaatatcaactgttaaattactttctctttcttctcagctgaaactggttctgccagcctagttccttcaagtacggtgcctatttagctgaacattgtgtgtatagtttttctggaaaatgatagcagaagcttggccagttttccatagttcatttatctttttaacataaaacaaagaatgctgtttttttggctcattaaatacctctcatagagtaatcttttcttaaaatgtaatatgttcaggttttattaattcaagagttatttattgcatgctatttatgcgtaccacatataatagataactcaagtctgtggtagtagttgcagttaatcaatattgttatcatattatttcacacttctttgggaagtcataaaataattaccagttcattaacttgggcttcttagagaggttcagagtaaagccaagtatgaaaaaaactgactataatgtggccttctgtacaggggccaccagtgaatggcagggctgggaccatggtgaggcaagtaaggcacaggcctctcttgtgaaatttaagagagtgccaaaaaactcactaatcaaaataatgtttgtatgtagttgttcaaaaaatcaaaattaatgcaaaataagttgaaaattatcaaaattttaaataaggagatcagtagtactgattttttcttttgccttatgacctagtatggttcagcctgcactggtgagtggagtaagggtcctggaagatccttgactggtgacatgaagaggacatagttttttgttgttgtttttttttgagacagagtctcgctctgtggcccaggctggagtgcagtggcgctttcttggctcactgcaagctccgcctcccgggttcatgccattctcctgcctcagcctctcaagtagccgggactacaagcgcccgccaccacacccggctaattttttgtatttttagtagagacggggtttcactgtgttagccaggatggtctctatctcctgacctcatgatctgcccgcctcggcctcccaaagtgctgggattacaggcgtgagccaccacgcccagctgaggacataggtttttttatgccagatagacttaagtttgagtcctgattcctattaacaattggatctttggcaagttaaagtctataatgctagctaacattattgcgtattagggtctgttctcaagtagtttacatgtatttactttagtcctcatgtgagagagagactatatggaagctaagagaagttaaataattcactcaagatcccatcactctgtagctaacctgagatatactcgtggaaaatgtactgtcacgttgagtctcagtttgcctgtcaataaaatgggacagaattacctgttttaagttggtagttcaaatggaaccttctgaaaaggaagtgtggaacatttgaaagtatacaaaaaggggacttttcagatcaggaatatgattaaaacactgctttatgtaatttctaaatttaaagacagtagcattaggtaggcctgagtacctcatatcattctagaacactaaatctgcatatagttacatgagtgtacatgggccaggtttggtgaatactgcatttctgagaaatggcctttaacatgaaagctcaatgtaataactgtggatgaaatagaagaagagggcagtgaaggtggggatagaggatattgtctattaaagtgtgcttcagtagagagaactaatttgaaacttctcctttctttttactaatggaacaggagcaagtccagacagatttatgcagttgtgaaattgagacaggttaaattcagtgatttttgataaatgttgttgccagcacaaaagtcacaagttgttgaatatggcaccttacatttgcatagtgagttacagatgcataggagtatgtcctgtgaggcttttccttgtattaggacttgagatctggaccctttaacagtacctttcctaagtgattcttattaatacttatgtcctattaaaatcctttatcaaatatgatgtttccctaaggggtcttttgtaaaggaagtcttggttactagcatctccatctgtggcccaggcttgagtgcagtagagcaatcatggatcactgcagcctccacctcctaggctcaagccatccatcctcctgcctcagtctcccatttttaaaactttttatagagacacggtctcacatgttgctcaggctggtctcgaattcctgggctcaagtgatcctcccacttctgcctcccaaagggctggaattacaggcctgaaccactgtgcctggccagttagtagcttcttaacacatagcaacataatttccatactattttcaactaatttttattctttcagttgggacctttatatatttcagtgttcagtgaagaagtaggagaatctggttcttaggctctgcctatatccttttacctgtcttgggtaactgccaagaaattaaatcaacaaattttggcctgcagtctggcattaatagatgtgaatttagctaggtttctttcaacacagtctccaggtcaatcgtaatcttatgtgaagtttcttattcaggcatgtctcgttagcaccattaatttcacacaggaattctttttttctccctttttttgtgactaagcaaaatgagaaatatttctctttcaggatatggagaggcttaattaaattctttaattttgtctacatctgcccttatgaatgatagcaaaggaatgggggatatcagaatatgagaaaaagtaatcatctaaaaatttccaagcactttaaaatttattaagctagcataaatatgtgggtgtgatagaggttttcattaagcctcctctcaacatacagtagttaggaatgaagtttagtgtctctccgtcctcctgtcatatgtgtgtatgcacacgtgtgcacatgcgactgtgttatgcattttgttttcatatttcttttagttgggttttaccttacaacccaacgtaaggtaaattaaaatttctattggatttccgcacattttctagatcctatttattcactgtcagtgaccttcactagcacttagtcctctgagtccaaaaatgtattgccaattcttagactccatcagccttctcctatgaaaaagtaatgcagttaatttctgctcaaaatgctcttctcctaaacagtcttctacttgatctttatgaaaagagttttatgaaagaaaagtgaaaataaagactaagaaagacattatttaagtgatgggtgatattattcagtgaacacattcaactatagcattctatccagttttttgccttcacgtaaatatgaggagaaaggtaggtgttaataagaaaataatctgattaggatttatgtagaatggtagcatttagggtattaaatctgtatagattcaggtcattttcctgcagtcactgtctataatcctgtgtgctgaacactgaaagttagatggactctgaagcgctatagaatcctcacttttcaaacaaaagtttaatttttatcacactagtatttattgagcaggctactataactgatcactgtactgggtattgtgaatagacagaaaagcccaagaggcctgtgttacctgacttctttattcacaagtatacgtacccagagactgtctgacagtgaatgcagtttctcctgcataagacatggtggcagtcttctgaagtcttgctggggagatgaagcatacagagatgtgtaaaataaaacagtttgtaatatcccagtgtaggggcacagataataactatggacactcagacaaaggaacaagtactgtgggacaaaagagtaaaatcagaggacttttggtgcactgcttagatcctaaatctttgaatattagtggtgccttagaagatggataggtaggagaagggtgagaggaagggagctgaggagactagaagggactgttatttcctggaataatcattaccaatttcttcatcacgttttcttaatgacacggtttcaaacgttttcttcatcttgattgctgtcttctgtgtatatgctggtttgtgtgaggttttactaaaccagtatgtggattaatctagtttcacagtgacaggtaagtgatttagaaaatcattcctttagcacatgttaacttgaacgtttggaggtagaatgcctagagtgagggtgaaggagaggacctggggacaggaagagagggcagctgggagcaattatgctccttccctcagacctttttggccttgactcttgattcttgtacttctaccagacagagaggcggtaggcttgtggccatgttttgcgaggaaaatcagaatctaagaatctctaaggcaagagcaagaatggattgggataggggaagtgataggaaaacagaggcactaagaagagggttggttttcatgtactgcatagttcattcccttagttgagaaatcaggtatctcaacctcagatatcttctgtccagcatatcgctggccagatctgattcatatgagggatccagagtaaggaagcatctgttagccaagtctttggttaccccaaattagctcaggtcctttactgcttgtttcctctgattatatagtacatatccaaaccctcaattttccagaataaactaggtctgcctattctgtgtggaaaacatttgatggtggttaagattctcttgcctagacgatggtagtgccttagtcgtttaactgcctgtcactttaagattttgaaatactgattcttgttgtgtaagccagacacatcttgagaatattttacggggcaacttgccctttctgaaacctcagtcatcctgaaaagtaactctgtacctccttgactttaatttttctgtcttaattctatttgtatacaatgtttgtggtgtctgattctctgtctcgtattgctgaaactcatggccttgaatttctgggtcactcttaaaaaatagacataacttgattactaatgaaaaagtgactcattttcttccaggcaaaggctgacactgactgtcacagtttgtgacagaagcagactctctaattaggagacatcacctattcttttctaaattttataagaattgatgatagcatcatgagatgggaagtgagtaagataagcgtttatgcttgtagagaggatgcataaaaatgaaatctggataaagttctatctgaatttacctttttaagtggttgattccctgtgagcttaaatttagtgcttctcttcccagaccgttgtcttacatacacacttcagtcagttttagccttgtataactaatcagcaggtcagattccatcgaggctgaaatacctaccaccattctatgctcaagaaaacaggctctcatgttggccagttgtttgggatagaagatggttagacctttctatcctttttaaacacaagattctttttcattccccttatcttgtttaaatatattgttccttctctttggttgttctttgctttcttatgcatctgtgaggggctagctgaaagtgtgagttgtggaacaattcatttacataagtgtatattgaattatctgtgcacctagagggtgatgggcactgtgagggatattaaaaaagagacacagtacagttcttaccctaggatcccctgcttggagtgggacagtggtcaagacatatacaaccacaaacacccaaacattaacatcaacaagcatcattacatccttgggtggtattgccaagggacttcaaaggccaagattatagagtcatcacacttaggaggtcaaagggactttggaaagcacctttgtcactcattttgttttataagtgaggaggctgaggtgtaatacagctaagcgaattagcctttattacataactcattaggatgtagactgggactaagagctgtttctccagatcccattaggcaatctaaagattctgcactatttctttttcatttttggtatccaaataggtacagttgtttttgatctaggaaaatccttttagactaaacagtaagctttttaaattactctgcttttagatattttttggacttcagaactttgaaggtggtcatccaccaacattggggaatggaaagaaggctccaacacttttctttctagagatcttctttaattttcaatggcagtcactacagaatctagcagttcatgctattgaggccactttgtaggattttttttttttttttagtcagggctccaggtccctggtggtttatgtagtcagtcttatcaacaaccgatgaaagaccaataaaagtgcaagagggaatgaggactgtgtgtgtgtatgtctgcacatgcacacatgcctctctgtgtgtgttggttaacttcatatttggtaggtgggagggaaggtgattaaaaaataatctactttgcatggagttggcccaatttgactgatataggggtgagtgggggttaagaagtagtctatatatcaggaatcttaattagttttgaaaatcctttaggtaaatagctcaacccagttgttcccaaacttcaagtgtatttatagggtctttttaaggggtaaagattccacagagcccttcattttgaccttttgcttctgcactgaatagtcgaatgccttctatatgccagtcattgtgttaggcactgggagtatgagaattaataattttagtctgttgacagataatcataataagggctaatgagtaacacaggctcagggttataagaacagagggggtgtcaaggctgtttttcacaggaaataacatttaagttgatacaatgaaattttagggcttagccatgagaaggtggggaaaagcattttgggctgactgaacagcgtgtacagaggtctggaagtgagaagtagtgtactatagcattttctaggagctgaaaggcatttagcaagagtatagcgcataaaggagagagcttgagatgaaacaatttctcagtgtgttgtttgaatacaatgtatactgtcaaaatctaagaattcaagaatcatttaatatatctttatgttttactagtcataaaagcatatacatatatttaaatatggacaagatactgtttagtagtttagaaagtgatttatgaggattgcaatcccttgcaataactccacagcccataccttgggaacaactgagctaactcattcagttttgtccattacatcgaagggtgttttttgtaaactcatatgtctagaatgtgtttgccatgttttaatcacaagtagatattttctcagagtccagtgcagtgaagtatggtaagatcctgattgtgttctggaacacagaggaaagaccaccttctgttatagcaacaacacaagtcttttaacactgtgtgccccttcccaatctttcaagtgatgattgaagagactaggtgctcagctcagcctttgagttctgataaatgagcccagactgtaaactggaagataaggatgtttgtaaagttcttgtataaataaagcatggtttctcattgcagtggttactgatttcatagtctgagtgaagatgaatgatgctgtgaatcaacagctttaaagtccgtaccacttcagcttctttttggtttaggtttcttaaaatcagtgtgtatttaatgctttattcagatgagggggtgaaaaacctaacacatgtaaactaagtgaggtggggtttcagagataattcccagcctcacaattcctcatgaagttcttttcctgtgggaaacttttaatttggaagcatgcaacctaatgtgggaaccaagattaacattttctgaaatacttctacaagaaaagcagaaatggtctgtccaggaagctgaatttacatagtagaaaaatgagctgccctgcagtatttggtagtctttgtgtattggttgtgataaaagtgtgtatgtgtgtgtgtacgtgtgtgagagtgagagattgtatacttgtctttgtttccttcacatacaactagtaaggccctagaaaaactacactagaaagtgtgttttaccacaagcgtcccagttctggacaccaatctatacacaaatacttttttttaaagttctttttgtttttccttcttgctgagtaagctatagtatttccttttttttctttctttttatttgagagaagggggggttgagagtagagtgggaatggcaagaagtagtatgacagagcttcttctctttttttcccctctttaccaggaagttaactagaagtcttcatgcatgtttttaaaacaaagttggtaattagcataacctagttagttacctttacacagagtgacagaattaaaaagttgacaagcccatcagacctcagccaggaggtactgaaaggagggagaccagtgagtctagaccaataggtgggttaggcctcctgaatgccagcctagaagtttagacttgattctataggctctagggtacctacaagtttgtagtcgcagccttgggaattgaatgttacataggaactttcactggttccagctagccttggctgttagcaattatttttatctactttaacaggggggacagagtaggggggcaggaaactaagctggcattatggtcacaggaaagaacagactgatttggagcctttcaaactgcagacctttgttactgaccgatgcttaatttggtttctgggttttgttagttttttcccctgcccttacctcatttaccttaacgacagctcccccctctagagctcagctagggcaggctgccactgtggattggggggccaagaggcccagtgcaagaagaaagtgggttgaaagcagagttctgtttaaagaattttctgctggaaactagcccagagggagtaaagaggagctttaatgaggagcagctgcagtgccgacgcaacccacatgagacttttttttccccttcgttccacattctgtatagtttttttaaaaatcatgactttgaaatagctgttttgtaaagcatgcctctctttttcttcttgtatgtggtgggattttgctttgttgttgttgttgttgtttcttgaatggccaaatcctcgttttaaaaaaaaaaaaaaaaaaaaaaaaagctaaagacagagctgcagcaaagccctggatgcaatttggcctcaccctgctgatacagaacattcggtggagaaaacaaggggagagaacactggcttttatttggaaaaggggcttatttcctgctcagacttcagtcatcttggagctgacacaagctgctacactgttttaagcttttctgtagacgagtggctattcacttaggaaacgtgaaagaacaaatttttctgtcctgtattactagagagactgatcctgaactgcagccattgccagatagattggaattgctattcagatcccagcttcgttgaaatctgtaaagtggctacatgtaaactaatccaggctgctagtgagatgtgagggttggggtctggttttcatctgcttaagtgagaggaaactgtaggggtatccttcaaatggaatgttttctagttccattaggaggaatcccttgtttttctctgttttcttccttcctttgcttttctacatccaaccccatgcgtatgtttgaacagtaacaatggaaatgtggacctctcaatgtcagaaatgacacttttttttttttgagatggggttctcaccatgttgcccgtattgcctaggcaggtctcgaacttctgctctagcaatctgctcgccttggcctcccacagtgctgggattacaggtgtgagccactgtgcccagctgagacttttaaagaaaaagtcataaatatatctttatggacctggtaagtattcagattagtttatagagtttaaaatggaaaaatgctccccaaacctttctctgtattcacaacctcatctgcgaagtatgttctttcagagttccaatgctagagaagagagagtaagtagaagtcactgagagacattgaagagacagttatgaaaataattaataaactccctacaggagggaaacattcatatagttttgcggatgaaaggcatctgttagatttttgtggttattttttagaatatacacctttagttcaagtggtagactattttccaaaatgtgtgctgggtagcttaatggaattatagatacgtaagggatgttgggtgtttagccatgttttcactctctaaccaaattcaactttagccatctcaagaagacagctatttaagcccttgttttcaagcagagaaccttactttccaccaagactaacagagtatattttctccttataccacagttgaacagggatttgcaagttgaaagatctcctgccttaggaaacaagggtctgttatttctgactgtcttagctattactcccctttcttcccatgtccataatgctgcttagcttcctggggtgtgaaggataattctatacctcaggatgactattaggttgatttggcctgttattctaccagacagatcacagagtagagatggattttgtggaacatttggattgagagactgactttatccatcacatgaaatttagcctgctttggaaccagctgcttagtggggtttatgtactcaggtattcagggaacctacaccaagggttcaagacagggtcttccccacaaaaactatctagatgggagtttgagaaaggtacagcaaagacataacagtggcttaaataaagaagaaccataccagcggagacaatgtagtgcatgacatggcactacatctgctgttggaaggatcagagacaggtgggatgatttgtagaaggcttactataggacaggtttacagcagatttttgaaaaaagggtggaagaaaggaacctaagttggagatataccagaagggaagcatgatgtttctcactggaaattaaaaagatttcaatataggggacagtaaacaagattgtggaaataatatggagtgttcgagttatggattactaaagagtaagatggttagatgattggaatgggacagacaagcagatcagagattgtaaagaacttggatttgaaaggcttggtattaatactgttgctagtttctgagcagaagaatgacatgaaaattatgcttaggaaagattattcttttagtcatatgcttaggttcagcaaggaatttccagactgtccttagggagaggagaggtatggataggatgctggtccatttaggatgttagagctgattgaataagtgctagtcttggggcaagacttagtcatacactttcagttaagtactgtttcattgcaaggtctaggtgaagatagggatatatttgtaaaactggggaaattgctagattcacagataaccaactttgggtagatcagttagctttggtgtccttctcagtgctataggggttcagaccatttggtttctgagatcactgctgaaattctgtgattgtatgagtataatgtaaaagttgtctcaatcaaggaaacttggagtaaagactcaatatgatggatttaaaaggaatgaatgatagttccaattattgggttcaaaaaacatgtgctacaagtataagatgagaaaaatagggtacactagtagttcatgtgaaataaggctctgaatattttagctgagtgtgtattccatagcacatagtagtattttgtggcttctaaaaaagtacacatatccattgggtatgagtcggagcgttattctttcttgaactgcgctctcacgatgcctcctcagtttaagaacttactctgaaatagtaaaagcatagtgtccagatcaggaggtcatggttcagctctgtgctgcactggtaagaacatgtgttaagcctttttccattttgagcctcactttttaaagaggtttttgatgaactggagtcatccagtgatggggaggcaggatagcctagtgttgaagcacacgcactctagagtctacttgggtttgaatcctgcctcttccatctactagctgtgaattttttttttttttgagagggagtctcgctctgttgcccaggctggagtgcagtggcgcgatcttggctcactgcaacctccaacttctgggttcatgccattctcctgcctcagcctcctgagtagctgggactacaggcgcccgccaccacgcctggctaattttttatatttttagtagagacagggtttcactgtgttagccaggatggtctcgatctcctgacctggtgatctgcctgcctcggcctcccaaagtgctgagattactggtgtgagccaccgcgcctggcctagctgtaaaatcttaatctttctaagcttcgagttcctcatatataaaatggagattataatatagcactggagcgagtaatacaagagacaatagctatcaaatgcttagcaaatatacaatacatagttaagtacttagaaaatatgttttcagttacttcgggtatatacctgggaagggaggcagaaaattttggtcattctgattattattactactgttaagcatagaagcaccactaaaaaggtgaagaagcctggaaataaccctatactgaggaatatgccaaaccattgaatcctggaaaaaagaaaacaaaaggcccacataactatcttcagattcttgaagggctacgtgtaagagaagcagaaggcttgttcttttttgttctagagggtagagataacctggaaattgtagagagacaaagtttgttcttttcaaagttaagacataatttatgtatcataaaatttacccttttaaagtgtttaatttagtagacttcagtatttccagagttatgagaccaccaccattatctaatttcgaaacatttttatcaccctgaaagaaattctctactgcttagtagtcactgtctatttccctttctttacagctcctggcaacactaatctactttctatctctacggatttgcatattctggacatttcatataaatggaattatataatatgtggccttttgtgtgtggcttctttcacttagcatgttttcaaggttcatccatgttgtagcatgtatcagaatgtcattccttttcatggccacatatttcatttatggatataccacattttatttatctgttcatccgcttataggcatttgggttgtttctactttttagctattatgaataatgctgctatgaacatttttattatctgggcatatgttttcagttatctcgggtatatacctaggaagggaggcagaatttgaagaattaagaaagagctttctcacagtggaatccacccacattgaagactgttcttttgttgaagtagtcagccagtaatttcacttaacaaatgcatagtgtttactatgtgctggatagtgttctaagtgctttacccttatttaaaaatcctatgaagtaggcactgttattacatctcttttacgacagggaagtttagtaccttgcccaagattacacattgagtaaatggtggagttgggattgaaatccaggtggtctggttccagagtctgtactcttaagagcagaacaataataactccaagcatttattaaattctcaagatttatccggcaccatgctacatgcttgtattcaagcagaggctggtgatcatcttttagaaatattttagaaatgattacttaattggatagaaattaaatttcttgaatctgaaggttctgttattccaaggatggctggaaatgggggaaaagccagcaacaagatgatgtctggcctgaggcttttaagatgatcagaatttgtatcaaaaaggaaactgtgaacacgaatgataagtattataggaattcagttaacaagtcttgtcagaatgtggtaataaattatatacaacttaaagagatgaagttactttaaattgtgtgtggaagccttagaaaaattgaataattaaagtttcttgggaagatgatctccttttacaaatgtttagtttcaaatagtggcagcacatattaggatagagagatgacttctagaaaactgaacatatgggactggaacagtgtattttggagtcagttacaggaaggaagttgtttaaaaccaagtgaacaacaacagtaacaaatgcatttgagagaaagagcagtgcagtccagacttaaacattagggtggccataatagatggggaagaaggagaaatcagcaatccagactaagacttcactgggttttgagttagacagagggaggcatagaagccaaggtaaaatgattaaaacggtacatggagtggttagcaattctccctataggagagagaatttccttatgaagtttcagatgagaccactgaacttgactagaggaaagtcattgtttttagaaaacagtttctaaacaataattagaattaaagttttgttgcagagggataagtaagaagtagatggaaaagaaagaggaatatctgaaattaggctacagtcatagaaggttagctgtgaaacaataatttggaaagggaaatgggacctcatgaaagtgtgggttaaaagagacttgtatatcttctaaggtaaaagtaaagaactaagctgatgtccagccctctaaaacattttaaatagaaatcaaactttattaatacagtaggtctagtttcacgtaaagcaaatatatggttctgtacacgggctttaggagagtaagtctgttgtacctcatatgtaagtattatcccatttagaggaaaaccctaagtctttctttacagtggcttaaaggccccaattgatccacatcccagttacagctctcatctattttctgctgctccagatattcttgctgtttctcaaacacgctagggctgctctctgtgttatggcctttgcatttgctgttccctttctcatgaatgtgttttcctaagatacctgcatgattactctcaccttatttaggtctcaactcaagtattgtcagtgaaggtcttctctgattttcctattctaaactgagatacttctctttgctcaccccacaccctcatccccagctccattccttcctgtttaattttttttcacagcacttaactccatctattgtgcatcttttacttagtaattttgttttcgtcttccgctattagaatgtaaactccaagagtgtaagaatttttctagcactggaaaaatgcctggcacataataggcatttactaattgttgtgtgaatgaacgattataagtttaatattctttgtggaaactaataaggttgatttcctatcagaaaccgatcattattaataagcatattggatggtatttatagaattagccttcatatgttctctactcagaagttggcaaactttttctgtaaagtgccagagagtaattatttttgcaggctttgtggtctcattacagctacttgactctgttgttgtagtggaaaatcagccatagacaatctataaatgaatgagcatggctgtgttccagtaagactatttatggacactgaaatttgaattgtatataattttgaaatgtcagaaaatatccttcttttgttctttttttctaatcatttaaaaatgtaaaaaactattcacaggccaaacaaaaacaggcagtggtccaaattagacttgcaaactgtactttgtcaatctctggttttactgatttcttaaatatatcttaggttaaaacttatttttccatacttgatagggagcaacaatgtgaattaaactgtagaaacaaataattcagaaatacatctgtttagctttagaaacttccattttgcttcatttttgttttcctgggaaccttatatttccattatatgtttatgatgctaccatttaaatgactttgcattctcttagcatatgccacatgatagtgttagggtggtgtaatagttcaggagcaaagctgagcaaagcccacccacgtttaaaaatttgccattatttagaaggtgcataattcccatatgggagaatgaagagtcatctaataatgcccagagggctgcactgtgagtgagaattgtgttgcagtttttaacattcataacacatttcttgaataagctgcaaatgcttttaataatatatctcagagttaattttagctatgctacattggcactttttgctcctccacttcaaaaaaccaacacaagaaactattctcaaatcaagctgtgatttggatggggcattgtattttcctcaataagcacaaagaagagagaaaagatgttttcacttggcaaaacttttttttttgagatggaatctcactctgttgcccaggctggagtgtagtggcacaatctcgtcggctcactgcaacctccgcctcccgggttcaagcaattctcatgcctcagcctcccgagtagctgggattacaagcgtgcaccaccaccctggctaatttttgtatttttagtagagccagggtttcaccttgttggccgggctattctcaaactcctgacctcagatggtcctcacacctcagcctcccaaagtgctggaattacaggtgtgagccactgtgcccagcccacttgcaaaactttttaacatttataaggttttttacatacttgattttgttcagttcttagaataatctcatgatgtaggtgaccttattaactatttacaatgtgagaaaatggatagtcaatgaagataagtaacttgtccaaggtcacagcaccagaactccaaaccagaccttctgaccttcttgatacagactcctcacagtcacctgcatgccatctttggtttcagtgctatgaactttcttcactgcctgttggtctgtagctacacctactcatgaagatgcccagagccttagccgctccttgctctgccatgcttatcttatgcagctctgggaggggtgaagaggctgtggccagttacctcactaccactatagctattcaccaccctgttttctcctttagccattttagctactacacaattcttctgggcattttctgtcttagttccctagtatctggccttccctcttttctcagtaactgtgacccctgctagctagccttgccaaccaatggttaatgaaaggtcttggatatgactgtcaaagacaaaagcactcatgaccccaatgtttcaggtcacaatgattaggaaaatcaggacaacaaggcttgggcacagaaaagctggtttttgagagggggatttagagtttggtttaaatgtgtaatctttgaggtaatggtggaacagcctactagattcagttttctagtccctgaaaactaaaacgaggaataagttgaatcacatatttggggcaccagccaaatatatagcagcatttatagttagaatcaaagtgtttgtgtttcttaatttaaatgcttctcagagattccatttaaacaacttcattatgaaaatggagacttaccatgcctttttgatattgttcagagaaaattgtcataaataatacacacagtttgaaatggttgtacatcttatgaatcaaggggtggcatgtaaaaaggttcctcagtgcctcaatgtggaaaatatcatagaatgttattcttcaattgattccttccttgactttggtgtttatatggtatcttagatattttatgttattttaattatattttgtgtctttttatttggttaaaaatgcctacttaaatattaacagatttttaaatatccctttgaactcttccccattcctgtacctcctttccctttttccgttgtaatgtcagccacctgaacataacccagaaaactaggtatcatccaattgatgtttcagtggaaataagagaaagaagcacttactatttctcaatgcttaattgaggaaaagcacatgatatcttacatattttaaattggaggggataatagggtcaagttcatgcattatattgtggacatcttaatcctatcaaatggcttagtcaaaatgagaaagttaatgaatttaagcagacaagtacgaacagtgctctaaaaaaggtgctgttacaccatcccaacctgtacacacatgaaaaaaagctggggtgcattttgcgtttgaataagggtcatgttgactggccatggcagaccctgctagaccatacagctgatactctgtcacctgccaggactcaaaaggacatgggagtatgtggttaagttctctaaggactctttcttctaaagggaagcagttttataggtggtccttgtaggtctgttgattcacaatctcgtgctttcttgattggactgtattgttttactgtaattttttggacttacaagaagtcaggtgttttcatggactcttctcttttccatacagatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaactaatgagaccaaagccagtgctttcctaccttcagcagatacctttatttagcatcttttagatcatggtgtctggctcttaaatgtcccccagctctggtgcacatttaacattatgataaggaactgggatgttccagacaactatccctaacttccttttaagagtttcagggggcagagaaagagaaagaaaaaggaccaaatactttgactgcttaaagtatatatgtcagggccaggtgcggtggcgcacgcttgcaatcccagcattttggcaggccaaggcaggaggatcacttgaggctagaggtttgagaccagcctgggaaacatagcaagaccccatctctacaaaaaaacaagaataaaaataaaacaaaattagtcatgtgtggtggtgtgcacctgtagtcctaactacttgggaggctgaagtggaagaattgcttgagcccaggagtttgaggctgcagtgagctatgatcgcaccactgcactctagcctgggtgacagagtgagaccctgtctcaaaaaaaaaaatatgtacaccaggatggggaatcagagtttacttcactaaaagaaataagtacactgtcaccagaggaaaagttgctgatgttattgactatttgcttttagaaatctccctccctagacattcagggcactggcttttctggttttctgaaccctgttccttttgcttcttcattaccttgttcttatccattaaatgtttgtgctccctggagcactgttttgcgccctcttttgagccacatcacagctctccctagggaatttcactgtctgtattcgcctccactgccactgtcttcattagcttgctgatgaatctcaccatcattcccttagctccacccaaccctgacattcaggctcatgtttctagttatcctttgtatgttctccttggagatattctacaggtactttcagctcaccttgttgacagaaatacgtagcaaccatgtacatcccaaatacccacgctagaaactccctgtcccttgttctgacctcatttcaactcagtcacccaagccaacctctgagttgcctttcacctgtctattcctcccatttcctctgctaccctgtagttgaaggccatgttatctctcacctgggcttctgaagtagtttctgaatacgttttcttgcctttattctctccccatctcattcacccatgatattactacatctttgattataaatgcaaatattctaacaatctcacctgcttacaatgtctaatattttttcatcatccgcagaataaactgcaaactcttttacatgacttccatagctctctacagcctagactttacatctttttatagcctggcctccccacaagcatctaggcctagtcacaccaaattctccttatttcctgaaaatgttgtacttattattgcttccatacagttacacacccttttgcctggaatgcccttttctacaactggtgattgtccaatgttatttaaaactgtgtctcagtgaccctttcatgattcctttaggcaaatggtctctaagttttattagttttatgtatcacattttattgtaattttttttacacatatctcacctgaatagattgtgggtttttctaggtgggtctgagctttattcaaaagtgtttattaaattagatgagaaaaggaggaacattcttcattttttctcctgctttaagcactaaaccaagagttctataaatgcaataagcaaaaaagtgaaaaatgtactcagaagactatactggatcagttagtgtagaatactgttatattaatttttcattgtattagggttctctagagggatggaactaatggaatatatatgtatgtatatatattccaacccaaagtgtcttggtggcaatcttaatatatatatattggcaatctttatatatatataaaggagagtttgttaagtattaattcacatgatcacaaggtcccacaataggctgtctgcaggctgaggagcaaggagagccagtctgagttccaaaaccgaagaacttggggttcgatatttgagggcaggaaacatccagcacgggaaaaagatgtaggctgggaggctaggccagtctcgctttttcatgtttttctgcctgctttatatttgctgacagatgatcaaatggtgtccatccagattaagggtggatctgccttccccagcccactgactcaaatgttaatctcctttggcaacaccttcacagacacacccaagatcaatattttgtatccttcaattcaatcaagttgacacactcagttttaaccaccacaaatctaccccttgtcaacttgaacccgtacacatctcctgagatcacacataatcttcaaataaagacaataattaggtcataattacacctgatgtagtacaactattcttcatacatccggaaacacactagtccccaactgaaacactcttacataaagttaacgatacttaaatgctgatgtgaagtcaataaatcttatgtcacatgataaaggagaaaggaaataaaatgaagatattttcttagtacaagtgtgtgcaagcacagacatgtttttaataaaagaaggaggaaatactgaggacaattacagtcctcatttctgcagctggtcacatggtagtagctggtattgatgactaccttcttctacccattttgtattccttttgccttcagcaaacacctcagcaggttgtgtttttttttttcctgatggagaggcccaaaccatttgtagtcccgcctggattgggctgttgtagttgcccattgaccttaatcacagggcatggtaatactaagagacgccctaatggatctcctgtattccatgaatactctttcttacctccgttctggagtagtagactgatttcatcttgatagcctgggtcttgatagccttgatgtcccagccaacactgtaacgcctttcttagcctgtttacttaaaggtaggaacccaaagtgtcctggtggcaatcttaactaccagtttaatggaattgttgttgtgtcttctgatggcagcgttcctccctctggaactaagacctctaggccagcagaacttaatgttgcgggaacaggaagcaaacattttgctagtggatcactaggggtgatggtgagtggtaccacttccatttccaccccttgattcctggacctgtgaatcctggctatgggagaaacagtaccacatattggacgctgattcagagcatacacagccttcttgagaactttgccccaaccctgcaaagtattctcacctagttggcattgtaattgtgactgcaaaaggccattccaccgttctgcttcaggatgttggggaacatggtaagaccagtgaattccatgagcatgagcccactgctgcacttctttagccataaagtgaatgccttggtcagaggcaatgctgtgtggaataccatgacagtggataaggcattccatgagtccgcggatggtagtcttggcagaaccattgcatgcaggataggcaaacccatatccagagtaagtgtttattccagtaaggacaaacatctgcccttttcacaatggaagaagtccaacataatcaacctgccaccaagtagctggctgatcaccctgaggaatagtgccatatcaaaggcgcagtgttggtttctgctgctggcaaattgggcactctgcggtggcagtagccaggtcagctttccaccggcccatcttgttttctgcactgggaaggtggggcatgagcacaaatgttaggacctgaaaggtggtgaactctgcctgggcagggcaaagccagaggaaactctggtggaggtccgtagcagtcctgatgtgcaaatcggtcatccaacctgggtgtaggggcgaaagactaattgaaccatctagtagctggttccctccaaagtttccctcgggatagctggcactctcgcaaaaaccccactcttggtaccaatttactgtattagtccattttcacgctgctgataaagatatccccgagaccgggaagaaaagaggtttaattggacttacagttccatatggctggggaggcctcagaattatggtgggaggcaaaaggcacttctttcatggtggtggcaagagaaaattaggaagaagcaaaagcagaacccctgagaaacccatcagatctcatgagacttattcactctcatgagaatagcacaggaaagactggcccccatgatacagttaccccactgggtccctcccacaacacatgggaattctgggagatacaattcaagttgagatttgggtggggacactaccaaaccatatcattcatcaaaaggtgttggtggggtagagggtagttaggatgatccatgatctccatcatgatgatgatggtattgatgatgtaagtcactgaaaatatttggtgttataagaataatttcttcctgattgtcagttttgagttgttttgctattaggaggcaaagtaggggggcatatacccacttaaaatattttaattctggctagtggaaatgacagtaatgccttcttcataattaaaatgtcactctgaaatggtcccaaattaaaacttcttcctttgttgttaagaaggatctcttcttggtgtgttctgcaagattctgatcaccttttttttttttttttttttttttttttttgagatggagtattgctttgtcatccaggctggagtgcagggtgcaatctcggttcactgcaagctccacctcccgggttcacgccattcttctgcctcagcctcctgagtagctgggactacaggcacctaccgccatgcccggctaatttttgtatttttagtagagatgggctttcaccttgttagccagaatggtctggatcgcctgacctcatgatccacccgcctcggcctcccaaagtgctgggattacaggtgtgagccaccacacccggccgattctgatcatcttttatacatatgctatttttgtctatcactttaggaatcatcacagatcaaggtcatccttttggtttttgtgatagcgctatacctcagtcagcttactagctcatctccactcagagatgaagaagcataggcagcaagttagtgcctatacataatatatatggaaaccaaattcagggttgattctttctttctttctcccttcctttctttctttctttctctttctttctttctttctttctttctttctttctttctttctttctctctctttctctcttcctctctctttccctctctctttctgtctttcttctcactctgttgcttagtacagtggcgcagtctcggctcactgcaacctccacctcttgggttcgagtgattcttgtgcctcagcctcccaggtagctgggattacaggcatgcgctatgaagcccggctaatttttgtatttttagaaaagatggcgtttcaccgtgttggccaggctggtctcaaactcctaaccacaagtgatctgcccacctcagcctcccaaagtgctgggattacaggcatcagccaccacttccggcccggggatctttctgtttcagttgtgggcatcactctgaaaatcacacttgctagaagtgagcatttatatctcttctccactgtaaataagtgcctcttagtgacatgagtggaaagacaagaagaattgcagttccttcattttctgtcttagctccctgagatgtatatgctgtgcctaaatttgtgttatagttttctcctttgatttgacattccttgataggcagagagcacttttctgtgctcatatgtcacatctcgcatctttttcccttatagaaaaactcttgtgtctcccatttacctttctatgaggtcagagatttagatactttcctagacaatcaactggagtattaacaaattcaaggagttctcgccatcccattactgggtatatacccaaagaattataaatcgtgctgctataaagacacatgcacacgtatgtttattgcggcactattcacaatagcaaagacttggaaccaacccaaatgtccatcaatgatagactggattaagaaaatgtggcacatatacaccatggaatactattcagccataaaaaaggatgagttcatgtcctttgtagggacatggatgaagctggaaaccatcattctcagcaaactattgcaaggacaaaaaactaaacaccgcatgttctcactcataggtgggaattgaacaatgagaacacttggacacaggaaggggaacatcacaaaccggggcctgtcgtggggtggtgggacgggggagggatagcattaggagatgtacctaatgtaaatgacgagttaatgggtgcagcacaccaacatggcacatatatacatatgtaacaaacctgcatgttgtgcacgtgtaccctagaacttaaagtataataataataataataaaaattcaaggagttcttatctctgtagtttaaataataagcaacttagactaatgacaacaaaaagccagccatgtgaataccaaatttactagttctgtgaggatatttttttctctttctctttctgcctcaaagaatctgctttgcttcccctggcatcatgatttagttttcaacccgtcagagtcttcctgctagtgctggtactttcctacttgagaaagtccacggaataccttcgagacctctgtcctcctgatggcttctatttcatttgttatatagggacccagaggtccttcatcattttcaaacacatcaacagatatttatagcaaggccacaattaataaaatgtttcccagaatatatgtgtgtgttacatttagaggaaacagaagtagtattgacttgtttctatcaccagaggtctatttagtaactatattttgtggaaaatatcgatatattttatccattcaacagacatgatttgagagcataccacggagacccaaccctgccagtgtggcaggtggtataatagaagaaaatagcaaacttggtgtatctgtgtttgcgcacatgtatgtatgtgaggggcactaaggatgactttacagaggttggaacttttgagtagagttgccaagatagggagagttcactaggaaaacagaagggaagttgatttttttttttttttgaaatggagtcttgctgtgtcgcccaggctggagtgcagtggtacaatctcggctcactgcaacctccgcctcctgggttcaagtgattcttctgcctcagccttccaagtagctgggattacaggtgcgcgccaccatgcccagctaatttttgtatttttagtagagacagggtttcaccatattggccgggctggtcttgaactccttacctcatgatctgcctgcctcggccttccaaagtgctggaattacaggtgtgagccactgctcctggcccggaagttgatattcaaacaggagcagcatatgcaaagacagtgagctctgagagagtagatggatccagactcctattgctgatagcgtcctgcaggattgggcttcaatgtgactaacctacaattgcctccaggtgctccacccactgagtccttgtgtctctgctgaggtccttggagagttactggagagggctctgtgtcagatgaccttgaggaggctctgatttagccttttgtaaaatgcaaagagttgaggtcttctccacgcaagagctcgctgatgtcaatgaggtattgaggatggggccatctcctatttctgtggccagtactgagttttgttatccttcctttaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccaggtaaggagctccctagtgtcccaggattaggggacaaacccctagcacaggaggtagtgggtgtggctcaattgctttttttaggaagcgcaaggaaaaagggaagtgagaattttgtgtggggtgggttgctagtgagggaggagttttatgggcccactgtggtccataaactgagcaggggataatttagcatgtcagggtttatgatgatgagtggctagaaaattgtttattgtcccttttgtagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctcttttaataaagaatagataatgctatcattctagatactaaataagtattttcttaacataatattactatccactttatcttgtagaagaaataactaaaatacatctgtcttcactcctgtatttgtttgcattttaaggattaaagacagaaatagaaatgtaaacaactttattttgaaaatatttcaacactgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtgtgtgggaggggagattagcatgaggggtgggaatggggagattcgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtgtgtatggcgttgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcatatgtcccaggtggagttcagaaaatattctcttcatttccacaaaggggaatagtgcctggagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgttcattgtctgtcttttccaaattctactgcctcttaccctctccagaatgaaaactagtatctttgtttttgtttactgatgtaacccaaacacctacaaacagtgcccagtatatactaggcccacaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcctcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcacattctatggcttttgtgtctactctgttgttgctgagcttatgaactattagaaataactccctcttgcattttcacacatggggaatgtgatgttctcttgggtattatgctaatcatattttggcaggtttctctggagcagatgcagaaatgatcataccactttccagggtgtattattttagctcctttgacttgggccctaagtctgttttacctgatgttcctgaaagatgttcctgatgtccttcactgttctttcatgctggatgttcttgcctatgctgcctcctcagctatcaccctctcttcccctttttaatgtagaactcattcttaatgatttgtcaaaggcaccctatttcactgaaatgccttctatattccctaccctccaagtggattgtagaccttctaaggtcttttgacatctgcatatctctagcacagcacttatcacggtgattatttatctgttcatctttccaagtagacactctcattttaactccctaccctagtcgccagcatccccagcatagtgcctgtcataaaatggtgccacaatgaaaatttgaaaaatgaatgaacgtgataaacatagatgagaatcctatattctacaattttttaaatgtactgaaattattctttttgaatcctcctatttatttctgtgacttctttgatgacaaagttagaaaaaagtggaggtcagtagggagatatgaagggacgcaggtggaagcagtgagcctgggcgggtgatggagtgggagatacgtggcacaggggtcagtgagttaatctgggctcattcagagaatggaaggtgtgtgccaagaaaactggttggatagggataggtcagggattccctcttgcattctcacacttgggggcatgtgtcattttcttttcttttcttttttttttttttttttttgagacggagcatcgctctttctcccaggctggagtgcaatggtgctatctcggctcactgcaacctccacctcccgggttcaagctattctcatgtctcagccttccaagtagctgggactacaggtgcctgccaccatgctcagctaatttttgtatttttagtagagatggggtttcaccatgttggtcacgttggcctcgaactcctgatctcaggtgatccacctgcctcggcttctcaaagtgctgggattccaggcatgagccaccatgcctggccgcatgtgtcattttcttgggtgttatactgatcgtatatttgcaggtttgcttttgtgacagacttcttctgggggaaaaaaagtatccttctatctttttacttttgtccagttccaggtatccctgtttttttcttcactcttccttccttgttcatgggagtttttcttgaggacttcaagcccagcttcggagaatcctggttgtgtcatctcatctcctttctgctctcttctctacctagcctttccaccctcacacctcccggggtctgaaaatggaaagataagggtgtttccctgaaagttgctcttctgtgtggggatgacaggttctaaagactcttttctggtccctgccctcattgccatgattaatcagttaagtggcccgaggttttataacagcacagtcttaaaatgcttctcccaagtttaatttctctccatttgaccttttaaggatgtgaattggctttaagcagtagactccctttagtacggtgctgtgagcctctcagtgaatctgctacatccattccacccacgggtctggaaacttgtctgtttacctttccctaaaaacctaagatatatttttaagaagtgccttgtaacttttcatatagcctttcccctactttgggtagactgtttcttacaggaatttggtagatctttccaaagagaattctgtatctgtatttttaaagcataaatcctgtcaactttggaggagaactgatttggcttgagttttctcagacatgggaacttttgacctaagtttgtattttacattgttgaaagggaactccgggatcccagaaaacatatggactgcaattgggtaaagtttctgttccagaaatgcctcttctggacatttcatacaaatggaaacatgcagcatgtagtaatttatgacagcttctttcacttagcatgaggttttcaaagttcattgatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtataattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttctccacatcctcatcaacagttgttattgtctgtcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagtttttaaaaaatatatcctaaatacaagtctcttatcagataatatgatttgcagatattttctgtcattctatgtactgtcttttcacattcttgatgatatacttttcagcccaaatgtttttaacttgatggaatacaatttattttttcttttgttgcttgtgctttcagtcatatttgtgaaaactttgcttatcccacattacaaagatttactatttctaagtgatttataattttaccacctacctttaggtctctgatccattttgagttaatttttatgtgcgaggagggagtctaacttgattcttttacatgtggatatttagttgtcccaggaccatttgttgaattaagtgcccagaacaagtacatctatatatagagaaagtagattagtggttgtcagagactgtaagaagtggggaattggagagtgactgcccataggtacaggcatgctttttggcattatgaaaatattctggaattaggtagtggtgatggttgcagaacttttggaatatggtaaaagacactgaaatatatgcttaaaaatggtgatttttgtgatatatgaattatactatagaactaataataacagtaataaagcaaggtgtctttccacatctccatgccttgtattttcattaaaaaaaaaaaaaaaaaagcatttcagggccaggctcagtggtttactcttgtaatcccagcacttttggaggcctaggtgggaggatcacttgaggccagaagttcaaaaccagcctgagcaacatagcaagaccttgtctccatgaaaaataaaaaattagccagaaatggtgatgtgtgcctagagttccaactacttggaaagctgaggcaagaggatcgcttgagcctaggagttcaaggttgcagtgatctataatcaccactgcactccagcctgggtgacagaacaagaccctgtctcaaaaaaaaaaaaaaaaaaaaaaaaaaggcatctcactttaatagtaagaggccagaatatgatgctggcagcatgttgtgaggaaatgtattagatgaaagaagttaaattccagttctccttttttcagaaatgaggtataggggagagaaacacgtactttgaaagaattgacccagctgaattggaaaatgtgggaaggggatggggaagaggctgctccacctgagatctggctccaggacttacagcaaggggaacttgggcaagttacagactgtctatgcctcagtttctttatcagcaaaacagaatcatcccataaactataaggtcgatggtatcagcgggtccccaaactgactgcacatctgagtcatgttaacaaacacattccaggccccacctgagccctctgaatcagaatccctgtaaggaggatgatgaacttgaatttgcactgactttcccagctgtttcttactctgatcaacttgggggtaggacccattgagctgcatcacatcattccaaagccaaaacacaacagcaggacaagaatattttcaaggcagtctctaaagcagaggagaaactgttgagggaacttagaagtaaaggagatctggcttgctgggctccatttgaactttgagtacaacagagacatgagcccttcgggacacatgcctgaggtagtgacaatccaactttggaagagtggaagccctagtttcaaattcaagcatgctttgagtataaattaagtttacctctttttgcacagcaacatggccaatctttcctaagctgctcagcttacaagaaaaggaatcatactgctaagaattcaaacttcagcagtcataggtaagtaaggaagtcttataaacctattctagccacctaaccagaaactcgaaatttagcaggttctttcagtttcaggacagttgtgttcactagatcagaggcattgagacatgaagaacagacccttaaaaagggaaagtgttcccttcagtttgaggacatcactggaacattagggaagtgggaacacagctgctcactctacagtgtgggttgcctttgtgtctggaatgtgtctgacgtcctgatccctgtgcacatttcagggagccttgggaggaccccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtaaaatcttctccataagacatacattgtggttataaaaaggcaaaagtcttagtgagaatcattggtattccatagaagagtgaattaaacacagccaagggaagacccacgtctcatacttctcttgtatattccaaagttccagggaaattccaggtgatagaggttatttcccatactgttaaagcaaggtttcagacacttctgaattttggtcccagtactctagaagggcacacctctgtcctggaaaataatacaggaatgaatactcttcccgtgacccattctggtcattcttccagcatcacaaaaaccaaaaaatggaaatatggccaaatacgtgattagctgtccctcatcttcaggtttcttatctgttacttatagataatagcattaccttaaggattatgatgaagatacaatgtccaaatataaacacagttttgagcaaaatgccttgtacgaattggtcaatgaataattactaaatatgtgaatatttctggattgtatggatcctatgaataattactgaataattattgtgattgcttttattggcagtgctgaaaactcatccctttgtgacctcaagtaa

SEQ ID NO: 672 - DNA, 180196 bp, Homo sapiens
tggtattttggaaaactccctattacatacttgctttacctgaggtttaagaatggaatgaaactgggaatgtatattagagaaaataaggtaaagtttctcagctttttaatgatcatgagcccttttgccatgttaggctgtaataatgctagagtgttaccagcatccttttaaggaatgtgtagaggtaagtaacacttagcctaagggtcctcagaatactgtttgaaaatttctgttttcaggaaaggcttactatagtgggtcttaattcctctaaggattctgatagcagccttagatagcaaatacttctaatttaaaggtattcaaaggacatttctcctgaatggtcgtctaattatacctttacatcttacaaatgaaataatcaaagcctagattttgatattcaaccaagagtttggttaaccatggacagtggcaaatccaggaataaagtcagaactgttttggtttttttgtttttgtttttgagacagagtcttgctctgtcacccaggctaaagtgtggtggtgtgatctcagctcagtgcaacctctgcctcccaagttcaagtgattctcctggctcagcctcctgagtagctgggattataggcgtgtgccgccacgcctggctaactttttatatttttagtagagacggggtttcactgtgttagccaggatggtctcgatttcctgacctcatgattcacctgccttggcctcccaaagtgctgggattacaggtgtgagccaccgtgcctggccaactcagaacttttaatttcctacctcagtactttgatggccatgaaagaaatggtcagttttcttcatcattctagatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcaggtatctaaaagcaatgagtcttatgaagaaatggttctcattccatagacaaggatagcttattttgcagtgccttttatgctattagattctacctagaactgttaagaatttatctcccagaagtacattacattacaatgcttccaatatattttttttcctagcatgattagtttttgttgagttggaacagtgtaaaggactcatccatattagaagcaatgattatttctaacatattcacaaaattaattaaattatataacttgtataaattaagggaaatgaatgagagaaaactcaacaatgtattgcagtggttttttgagtagcctctttgggagactttactgctgccagatcaatctttataaaatgccattttcatcaaagcattcctctctgaaaaacttttaaatctgggactacaagataagatccagtctgacttatttttccgtcagtcagccattgttattgagagcttgttatttgtaaggcgttgtgctctacatatggaaaataaggaagatgcaaatgtctgtcattctctagttcacaaacattcttctgtagccacaccagcttctttactatccttagtggtccttagaacagaatactgccttatgctggacctgttctgtatgtaagacctccataagaactgtctctttaaagaacctttctctgatccttatagcctgtatcacattaatctcttctgtcctttaaactcctaaagcacttagtaacataatggttttagcacatattacatgtatgtgtgtttacctaatttaccttaaatatatttattaaatacctcttaccatattaaatatatatttaatatatattaaatatatttccatataacataagtatatgtttcatatatttatattaaagtaggcaaacatatttggataattaaatatttttatataatttcatatatttttttgagacagagtcttgttctgttgcccaggctggagtgcaatggcacgatcttggctcactgcaacctccatctcctgggttcaagcgatcttcccaccttatcctcctgagtagctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagccctttatataattttaaaagtgtaggtaattaggtaaaattaggttaaaagtatatgtatatttacctgatatttaaatattacctaagtgtttaatgtggacatgtaagctctttaaagatagtgcttatgtattttatatctgtttcacatactccttatatatcccccacagaaatggtcacaaataggttccttaataagtatttttgaattcagccatgctatatattcattagtaagtgagttttcttttattatgaactacaaactttaacctttttttgagtagtgagcagttattcatttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacataaatatttgttaaatgacttctccaagcaatagctttgtctttatgttatcctgtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttatttctcagtccctgactcttcttccgtcactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacagccggattgcaaaatagttttttctgaaatttcaagaagtgaaaagtttgatcagaatttattatgtcaaatggagagtttgtgtttattattaaaatatgccctatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatggattatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacataatctgatcagcatcatcagttaattagtatatgcaatgttagcctcaaaataaaaatgatgatttaagattcatggttgttgcagtgctgctcattttggttatttttaatgccttaatactttcggtaaaatacttccagggactaattaatgttttccttttttcctctttgacagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatctatgtagttaattaaagttaaagtttctgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatggagatttccttttaccttttttaatggggtaaattttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatatagctagaataatttttttcctttcttttatggacctaaatctgccaattgggaattttgtgcatgaaatatgaagttactttttatagataatcagtgcttttaagtccctaaaaggctcctgctgaagtaatgatgatgttcataataaaagcctttgaaaggctgaaaacctacatagtggtaccatagtatttggagcttctataggagtggagaggggcagctcattgttgagagttgcatgctgcaacctaatggtcagcaatgaaagaaatacttgtagaatgttcacttcagtgtgaagttttgttatctagttaatttatatacatatatcctttgtagatacatttctatctaatcttgttgagctaattaagaaataaggggtggggtaattgtcaacaaagggagaagaaagtggtttaagatcagggcagcagaaaaattagagaacaagaatatcataatatggctcctggttttctttataagaggcagtgggaagatctgactagatgaaatgtatcatcaaccaaactggcatctaaaatagaatgggataaatactgtatggggttattggaggcatattaagaaaggacacctaatttattttgggaagaagtatgttaagagaagactttctagagaaggagaatggggcattctaggaagagtcaatggcatgtgcaaaggcatgaataaagacagtgaggcatgttttggaaatgtaacagcttgattcagcttagcccatagggtaagcatagacaacagaggagacttgaggaatgagaactagatgggtacactatcataaagggacttgtctatcatgctgaggagtttagaccatcttaatggtagtggccaaggatggcatcagatttatagtttcaagtgatcataatattggcataaaagatatattagggaggaagcctgaagtagggagatgaaaataaggagccatcaaaggcagaatgaaacttaggcagatttcaagtgattttcaaaaatgatgtgatcagaggtaccagataataactattacataacactttctttgttaggagcttatttctcacactgaccaaagcttttgaagtaagtactctttacaccactatataaataaaccttacaaaggattctgctttgaggcatgagagagttaagtcatttgcccaaagtcacagagttagaaagtaatagagctaagatttgaacctaggcagtttggctccagagtctgtgctcttacactatattaccaccaagaggtcaaataaataccaaagaatgtattttcgaatttaacaatgaggaacttaatcatacaggcagaagtaattccagagcaccggagacagaagccagattgccatatgggttaaagagtgtgtaaaccactaggaagtaaagacatagaactactctcacaagtgcttttctggttattgtgacgctgaacttcatggcttgttttaattaagacatcttacaagtgtcaaaatttggaaatatttggacactgtacactctggttatttaaatatctaacagtggttcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgtaccaaaaaaatttcatatcaaataatattttcctgtagtgcattcaaggatctggttccacagcaaaaaattgttttggtctcagttcctcaaaatcacatttaaggagcttgagatttatattttctacttaataagtcttacaaaagcaagttaagaaggaaaatggacaatcatttctgcacatgtagggtttaataaaacatgtataatgaaatatttcatattttaaatttccaccttattggtagctttcatgacaaagggctagggtgctggtggccatacaattaaggtttttggttagttagttagcagaactaaatgactcctacctggtggctttttcttttgtttgtttgtttggttggttggttttttcccagatggctcaggaggaaggtaaatagcagtcattgtatgtgtgacagagtttgagatagaatgagcatattgaatcccacatcctgttcttattactgtcaggcagcgttgacctagcagtataaaactatctgaagcaatgtagtcactcagttctcataaagtttatttcaagtactgtaacaattcatgtttggattagaaaagtcactagaaatttgacttccatatagtaatctatacttttttctctcatttccttcactttttgagccgtaagtgtaaggcattttggtggtattattacaatggttatgaggagtttctttgcttgcccaaggtcacatagctagcaagttaaagtagattcaaatccaggcctgctagataccaaattattatttaagagtacttttcactactcctaaataatgacacagatatgtttgtcttacacatttcactttattgtcaagttattagtatgtttattttcaaaaggtattttttgcaatttctttttattattccgtactttttaaatttacttcattatcacgtcttcctttattctttttaaatagtttttgcttttgttattttgttttcccttttttactcttggtttgtaatacatctttccttatttgctcctttctcatttgatctcaatgttaatccaactgttttccacatctgattcactaaaattttagccctttaaaaaaaaattcctgtttttcctatctccttttgcccattctcttctccttgcctcacttcttttatctttttccattttactttcattttttgtttctctagatgttgttttgacatatgagttaatgtactggtacaattttgcatctgtaaattagagcttcagaatcaactgagtgtatttattctttatttttaggcctcaatttatcttaccttttattgattttataatatactatactctttcattttagtctgcatatgttagccaaagaagatatgcccctgttttaagaaatctctgtaaaaaatgtcaagtgtgacaagaattcttcaagaaacaagctcctctagtttgtcttctatatttagagcttcaacagttacctatattactggtaactcccaaatataccttcaaacttgttttttgggcccaagttttttgcttcatatatatctgttttgaatatcccataaataattgcatctaaagcatacctccactccattgttctcaaagataaaaccaaacctgtgctgcttcttatatttctagtatttaagcgtcacctgccacccctttacctgagctacaagtcacgcattgcattagactcctctgctttcttctttcacctctaactagactattcaccaaaaatttttaaatatataactttcaaaaggtattttattacatcatttccatcctttatgtttgggttcaagccctcattaactttaacatggattcttggagtaccctccttactgattttgttacacgtgtccctcttttagtcagtactaccatgataataccatggataataattttttcatttttatttttagtcttgctctgtcgcccaggctagagtgcagtggcgcgatctcagctcactgcaacctccacctcccgggttcaagtgattctcctgcctcagcctactgagtagctgggattacaggcacctgccacagctcctggctaatttttgtatttttagtagagatggagtttcaccgtcttgaactcctgacctcatgatccaccctcctcggcctcccaaagtgctgggattacaggcatgggccactgcgcccggccaataatttttcttttttttgtgctaatcatactacattttctttagaataaaagatcacatacttcagtttgccattcgcagtctggccccattgtgccattctagacttacctcctgccactccccaccagctttgttttgtcttagtcacacaaaataatctagcgtctctaaccagtcaaacattttaccttgtgccttggctcactctgtgccttttctccagaatatctttctgtgtacttttctcccatccttttacctttaaacctgctgctatggtttggatgttgtttggcccctccaaaactcacgttgtagttcaattgccaatgtaatagtgttgggagatgctacttttaagaggtaattaggttgctaagatggattaacatctttctcttgacactgagactgggttttcctgggaatggttagttcccaagagagtgagttgttataaaacagtgctgcctcttctattttgcgctttttgtttgcacaaactcggtccccttctgtttctctacgatgttttgatgcagcatgaggcagtcatgagaacccaccagatacagctgcctgatcctgaatttcccagccaacagaaccaagtgctaaataaaactctttttaataagttacccactctcaggtattctattatcgcaacagaaaacagtttaagacacctgctaggctcctaaccttgaggggctagaaaacaaagccagaggtccagtaccagcctcctcagagttagaatacacagctcatgagtgctgagctcagccttggcccctacaatcttccagaaatgaggccacttggctgagcccattatatgcaacattcagacccccaagggcatcaaagaagacaaaagcagaaaaacctatccaagaaacagcaacttcaaaggttgaagcaacatcagaccacacaggtgagaaccagcacaagaactccggcaactcagaaagccagagtgccttcttaccttcaagcaactgcgctatttccccaacagtggttcttaaccaggctgacatgacaaaaatagagttctgaatatggataaccttgaggaacatagatgcaaaaatcctcaacgactcaatttgctggactagcaaaccaagcccagcagcatgtcaaaaacgaatccaccacaatcaagcaagctttatccctgggatgcaagtttggttcaacatatgcaaatcaataaatgtgattcatcacataaacaactaaaaacaaaaaccacatggtcatctcaatagatgcagaaagggctttcaataaaattcaacatcccttcatgttaaaaaccctcagcaaactaggcattagaggaacatacttcaaaataagagccatctatgataagcccacagccaacatcataccgaatgggccaaatgctagaaatactccctgtgagaaccagaataagacaaagatgcccactctcaccaatcctattcaacatagtactgagagtcctagtcagagataacaggttagagaaagaaatataagacatccaaggaaaagaggaagtcaaactatctctgcagacaatatgattctgtagaaaaccccatagtctttgcctaaaagctctttgatctgataaacaattagcaaagtttcaggatacaaaattaatgtacaaaaattagtggcatttctatacaccaatagcattcaatctgagggtcaaaatcaagaatgcaatctcattcacaatagccacacacacacaaaaatacctagaaatatagataacgaggtgaaagatctctacaaaaagaattacaaaacactactcaaatcagagatgacacaaacaaatggaaaaagattccatgctcatggataggaagaattagtgttgttaaaatggctgtacttcgcaatgcagtttatggattcaatgctattgctatgaaactaccagtgacatacttcacagcattagaaaaaaaaacttttaaaattcatatggaactttaaaaagagcctgaatagccataacaatcttaagcaaaatgaacaaagctgaaggcattacactacccaatttcaactatactacaaggcttcggtaaccaaaacagcagggtactggtacaaaaacagacacatagaccaatggaacggaaaagagcccagaaataatgctgcacacctatgatctgatatttgaaaaaagttgacaaaaacaagcaatgagaaaaggactccctattcaataaatggtgctgaaataagtggctagccatatgcataagattgaaactggaccccttccttatgccatatacaaaaatcaactcatatgaagtaaagacttagatataaaacctaaaactataaaagccgtggaagatagcctgggaaatactattctggaataggacctggcaaagatttcataacaaagatgccaaaaacaattgcaactaaaacaaaaattgacaaatggaatctaattaaagagctttagcatagccaaaaacaaacaaacaaaacagtgaacacggtaaacagataacctacagaatgagagaaaatatttgcaaactatgcatcctagagaagtctaatatccagaatttataaggaactttataagcaaaaaacaacctcattaaaaagtgggcaaatgacacgaacagacatttttcaaaaagacatacatgtggccaagaagcatatgaaaaaatgttccacatcactaataattagagaaatgcaaatctaaaccacaatgagataccatctcataccaatcagaacggctattaaaaagtcaaaaagcaatagatgccggcgtggttgcagagaaaatggaacacttatatagtgctaatgggaatgtaaattcgttcagccgttgtgcaaagcactttggtgatttctcaaagaaccggcaacaattaccactcgacccagcgatcccattattggatatatacctaaaggaatacagattgttctgccataaagacacatgcacgcatatgttcatcgcagcactattcacgatagcaaagacatggaatcaacctaaatgcccatcagtggtagtctggataaagaaaatgtggtacacgtacaccgtggaatatacacagccataaaaaaataagattatgttctttgcagcaacatggatggagctggaggcaattatcccaagctaaattatgtaggaacagaaaaccaaataccgcatattctcacttacaagcgggagctaaacattgagtacacatgtacacaagggaacaacagacaccaagacctacttaacggtagagggtgggaggagggagaggacagaaaaactacctattgggtactgtgcttattaccaggtaacaaaataatctgtacaccaaaaccttaaagaaaagtgttttaaaaatgtaaaataaagcatatagcaaaacaaacaagacacctggtaaagttctgctcttccttcaaagacccagctcaaatgtctctttcataaagcctctctgacattctcataccccccttctctctgacctgggagaagctgtgttttcattctcccacaataacttgttcatatttctattataaaacctacaaatttaaactagctgtcagtgcatacttgtttgtctccttggctatgtgccttatgagatgcctgggatagagatcaattattattcaatttgaatccttggcattgggtgcggtggctgacacattggaggtgggcaacaaatattcgtggtataagttcactgaattacagagatgtatgcataagttttttggaactgggtttcatgaatcataggtacacacaatttgaataaaagaagaaaacaaagtggggcaaaagggtgtaggtctagtaatgaaatgggaaaagaaaggcacattgaaaagtcgcaacaaaagagagaaccagtacaattatatcaacatatagtaaacacattggagaagggaaaacaatacagcaagtgaaattgattctttggtggcagaaacaattgaaaggtatggaggcaaagaaggaggagaaattaaggcatagagataaattagacttggggagaaagcacagaagtcaaatatagcaacagatcttggactgggaatgtttccaattgaccattatgcttacgattacttttatgttgtggagacaatatttaatgagcatttcagatctgttaactaattttttgaaaaagtgactccagttcagtgataaataccttgaccaatatgccatataaagtaagaaatattttaccatacccaagaaactggttttaccggcttagttttgaccaactgatggcaatttgtacctgctaaactcccaattttttacttgctggttgtgtaggtaggcagtgaggtttgttggactgggcatgcagggacaagcagttaggccaatacatggactgaagattatatctatttatctgccttttgtttagctatttgcataaatatacagagtgggtttatttgcacacttagagctttagaataaaagaactttgactttcaaattggtttttcttgattttttaaaatttttatactccactttttcttccgtctttctcaaactcatttttccctagtagcagagttgagacttaatattacaaaactctgcttgctttaaagaatctaagaagaagaagaagaagaagaaaagacactaaagaacttccaagcagaagtttaagaagttctgctatagcccatccactcgtttgtggaatttaaatatatccgtttttgccacaataacagcgtagccttgctagaatcatatacaaagcagcagatttctttctataaattactggacactgtggtgtaatgtagacattgctgaggagggatgtaactgcaacagaaacaagttacttacattgcatgcagtagggaagtgggtgaaaagagcattgaactctgagtcgggagacgacttcaaggcccagctcagcactctagcagaactttaggtaagttttttagacactatgtacttcagtttccccatgtgaaaatgagaataacgtctgttctgcctacttcacttgaactatttgaggataaaagaaggtaaaatgcaataatggtcatgaagattttataaaccttgaagtgatgtacaagtataccatactgtttcacttttattactattataactgtttaaaaaagcatttgtgaccagtacaatcctggcttttctctggagactaacatccagtttcatagttattttacttttgatagggaaaagggaattattcctgttatatattgcaatatttaggatcctctagcaatttctcaggctaagacttcatgttcccagaagagggcagcaaaactccaaaggctctgccttttcctcaattaaaatgtctaaagcagtttttccttgagaggaaaagaactatactgtaaagaatagccctttaaaaatgatggtatttaggtgacaaagctaatcctattacaataaatataacattcattccaaataagatttttccttttctctgtcctgtgaagaaaataattgactgtttcttcaatctcatgttaattatttgacttatatttccagaaactcctacccatgtttttccatttaactctagatttgtagatcctacttagcaccagtttttaaataaattgtttcgtatgtgtaagagaaaaggtgttcaggcctgtttatagcttaggatgcctacctaagtccaaagagtgatcctcagcagtgtctaaatgtgttcctatcatagagtatatgtttgtcattcagataaaatgttgtctacatctaatctttctcattctttcattattcaaatatccccgtgcctttctatctttagtcagtgaattatcttgtaatgacaagagcaactaacatttgaactgttcttaactcacttaggccggaggttgcaatttttttttgtcaaaaaatcagaccttggtgataacttgagcagtaggctataagtaactagtaggctagcttactataagtaggctaggcatattaatagcgtataaggtgctctcacagacatgttttccctttgatactcaccatagccctgtgaagttgatagctactatcccccattttacagataaattttctaatctgtaatcaaaatagctgctctttgcttgaagaaaaagtccagagggacaccctatatgtcaagagagctccagggggtgggtaatttctttcataattgctagaagagccaattctgaatgtgaggctttttctatctgctttattacaaccagagatggaataggaaggctttcagttacagtttatcaattccttctgcttttgccagttaatctctagctttactcttttgaaaaaactacctgtttcccactccacttctgctaccaccactaccaagtcagagtcctctttctattccagccaaacctcttcctgttcttgagaattgcatcacattcttggcttaacgtaaccaacacccccacattggcaccagggagtgtgtagcccttctttattggctgaaagttcttgtctggtgagcatggaataagtcactcacttcctgaatttcagccctggctaaatttgcttctggaaaaacatatatatattcctcagatttttgtctgttggtttgcaaatctccttcactccagccctgtcctggaatgagcaagatttaccaaatagggacagcatgaaagggaatttagagggtagaggtagagggaaaaggaatagtatgtgtagcttgctgaatgagatgtctgctcttgctgtttccatttcttcacttctcaaacaatttttaacccaatctaaactggcatcagctcccattgtattgaaagggctttcactcaggacactaacgcccccccgccacctcccatattactaaatccagtggatacatcagccttgatcttacttggcatcagggtagcatgtgatgcttttggtcacatcctctttgatagattcactcttcctttgcactattattttttctctatcttagtcatgggtcttcagcatcctttgcaagctcctctttactcctaaagtactggtgttcctcagaaccctgttctatatcagcctcttttctctctaaacattttctgtgagaaatatcatccctttccatggcattattgagatccatctgccaattatttccaaatctctatcttccctgacctcttttgactgctttctagaacttcttcaattagaaattcctgaaagcctgttaaccaactccctccctcaaacctattcctccaataatgctcctcatccaaacatatgccacaccatctacccagtttttctaggcagaaatgtaggattcatccttaatgcctcttttgctcaccttccacattcagtcaataaccaaattcagtataatctacatatttgaatccatcagtttctccctgtccccactggcctaagtgatcaccatctatgtggcgttttgcacatccctttgctagtttcctgcccccaggttttctccccttggatcattttccactaaccactagatggttctttatgtaaatgcagttctgtaaattcaccacttgtgtttaaaatcctttagttgcttctcaccgtccttaggatggagtccgaacttcttatcacggttcataagcctctcatgatcagtaacttgccatcagtctgaactccactcacactgacctctagtgtttcaaacataccctgcttccttttgcctctaggccttcacagatgctgtttcctctgctcggagtgttctactgtagggcctctaacatctgtagactaaattctagcctcaaattatcagttatcttattcctgaatcagaactgaactgggattcttaatattttttttattaattcttgaattaaagccaggatttatattatcctatatatttctttgaaaaatgcaaagatattttctaatgaaactgtatttgaactaattaacttagggttcagtttttaaaaatcatagctgaatgtaaactggaacgtattttttttcatggtactggaatgttttcttggttgttattcatcatgacattctagctttggaatttttcatttccagctgacttctagcagtctcctttcttacctctcaaccccttacactctggttgccctatacttgcccctagatggatccagtttgcatgcagtggtagttgctgtgaggctgcggttaaatagagctgctcagactgcaacaggaaagcattgaatcgaaagcaaaggggaggaagcacaaaccgatacccaccacaaagctgctgagtgcccagcatgacccaagccgcaccctctgatgaggagtcttgtggaggagtaagaagccacagactttaataaaccatcagcacagcctgtcctccacttccctggtccagccttcccggatcaccatgagtatcaccgggtactgacctaagaagctgggtgatgacagaaaagtgaccagaaatgtagagtccagaggaaggtacccgaaatgaatgactgtagaccattttatctcaaactccctacacagtcaagcgtggtgagcacgaaggtccggggcatgagaatgtttctgaggagctccctgcttggggtgattcccagatgaagactcctaaaaatgttccctaaaaatgcctttgctacctccctgaaaggctgcttctagtagtggccaaaacaacttataaaaattttgtaactaaaaataaagcccttgcgagatacagttaagagaactttaaacatacactaaggtatgatgactatttttagattcctgacttcaatggagggaggagaaaggaaggagatggagcagcaaagacatatgttacctacttgattttgctcatggcctaccctgtttacatctgtcccttttgctatcaaaggagatattaaggaattataggaaagggaatgaaaagtgtggaaaaatatataggaactaagtacagattttaaacaccggtaaggtggagaactccttggaaatctagagcttcacagtggctctataattcacctgttcaggttcactacctcagaatctaagaaggtgagatctgggccctacttttgcagctggaaggtcagaacacaaagaatggaggtgactgactcagtctggaggaaaggttgcttggcttggctggaagtgggcacttgtgtcatcatagagtgccaacctcacacttcagataacagaacaggaaatattgttagttcagatgggagagcagaggactgactgtgtatccaagaccattaagttattcagtcacctctttgtgttgtactttctatcctacaagggaccagagctggctgtggggagcttgggcaatagatgaagcaggccatcaggccagtccctgttccttgcagctttcttctcccttctatcacgttcagcttctttaatctgctcaacccagaaagtcttccaagattgacatcattaccaaagtttaaatggaagaatctgaggcattttgataggagacaggggtgacaattctggagtagaggaactgtctctcacaaggcctctctactacaagtggtaaaaatttgtgctttattttaacaaccacaacaacagtgaattggaagggatctaataacagaacagaatttgtagtcagacaactttgttttgaaactattcttcctttcttcccttcctccctccctcccttccttctttccttccttcctttccttcggaaaggaaaggacagggaggatagccatagaatgggaagctccttagacctcagaggaatgccgcaagcttcccaagtctgagtgcctgcccagagtttgcctactttcttcagtagtcaaggatattcctcaagttgtgtttaatatctatgcatgagccaaactgtggtaggtgggtgactgcattccccaggtgcaatctttcagcatgtgacctgatgtagtacattacattccttagacaaggaaaaaatagcgatatgaatgcaaagagggggaggcagagagtgtaagctactctaaaacacttagttatgaaagaagaaagattggctagaaagcatgtgtaataaggaatgaattccatttttttaattgagagaggttcaggaatgtttatatacttgaggaaaaagcatagtgagagatcttaacaagtcacttcattcctaagctttgatacccccatccgaggtgaggaggagaggagaggagtttctataaagattaaaattgaattaaaatcatatgcacagtagtggcttatatgccacaaagccctttacacatgttaatttttataactattatcatctagtgactgtacagatgagtaagccctggtcacagctgttctatattttctaccctatatgacagagctgtcaagaggagacaggctcttgagtaggcagggctaagacacataaataagaggctaacattggtgtgatttgtatcttgacatgctttgagcttttggaggatggtgtgtgtatgtgtctgacttactagacacaatgagttaccatttatttcaacttgccctgtattcttattttaaaaatcttacttaaaacatggacacatgtcaaatccaacatgtctctaaaaagagctaatgtttggagaaaattttagaaatattcacaaactatgcatctgataaaggtctattcagaatctataaggaacttaaacaattcaacaagcaaaaaataaccccattaacaagcgggcaggccaggtgcagtggctcacacctgtaatcccagcactgtggaaggctaaggcaggcagactacttgaggtccggagttcaagaccagcctggccaagatggtgaaacctcccctactaaaaatacaaaaattagccaggtgtggtggtgcacacttgtaatcccagatactcgggaggttgaggcaggagaatcgcttgaactcggaaggtggagactacagtgagccgagatggtgccactgcgttccagcctgggcgacaaagtaagactccgtctcaaaaataaataaataaataaatagaatacatttaaaaagttggaaaaggacatgaacagatacttttcaaaagaagtcatacaaacagacaacaaacgtggaaaaatactcaacatcactaatcattagagaaatgcaaatcaaaaccacggtgagataccatctcacaccaatcagaatggctattattaaaaagtcaggccgggctcagtgcctcacacctgtaatcccagcactttgggaggccgaggaggatggatcacctaaggtcaggagtctgagaccaacttggccaacatggtggaaccctgtttctgctaaaaatacaaaaattagccgggtatggtggcacatgcctgtaatcccagctactcaggaggctgaggcaggagaatttcttgaacccgggtggcagaggttacattgagccaagatcgcaccattgcactcgagtctgggtgatagagcaagactctgtctcaaaaaaaaaaaaaaaaaaaaaaaatagtcaaaagccacagttgctggcgaggctaccaagaaaagggaatgcttatctattgtcggtgtgaatgtaaattagttcagctactgtggaaaagtagtttggtgatttctcaaagaacttaaaacaaaattaccgttcaacccagcaatcttcattactgagtatatatctaaaggaaaataaaccattctaccaaaaagacacatgcactcacatgttcatcacagcactattcacaatagcaaagacatggaatcaatctaggtgttcatcaacagtggattggattttttaaaatagggtatatacatagcatggtataatacacagtcaaaaaaatgagtgaaatcatatcctttgtagcaacatggatggagctagaggtcattatcctgagtgaattaaggcagaaacagaaaaccaaatgtgttagtaagatctcacaagtgggagttaagcattgggtactcatggacataaagatgacaacaataggtactggggactactagaggcaggaaggaggaagggggacaaagcttgaaatacttacctattggtcactatgctcattatctaggtgaggggatcattcacaccccaaacctcagtgttatgccatatacccatgtaacaaacctgcacatgtactcctgagtctaaaataaaagttaaaattattttttaaaataaataaataggtcgggcgtggtggctcacacctataatcccagcactttgggaggctgaggcgggtggatcacttgaggttaggagttcaagaccagcctgaccaacatggtgaaaccccatctctgaaaaatacaaaattaactgggcgtggtggcatgctcctgtaatcccagctacttgggaagctgaggcaggagaattgcttgaacccaggaggcagaggttgcagtgagctgagatcgagccattacactccagcctgggcaacgagagtgaaactccatctcaaaaaaaaaaaaaattaaaattaaaaaataaataaataaacaaaattaaaagttgccatgttgaaaaacactaatccatcttgagatgcaaggatctgtacaaataagactatatacatgaacttcaggttacataaaggagcagtttctgtttgtaggtggggggagtaaactttttgtgtttctttctggctcattgcaggatcacattataattttgctttgatacaaatttggcaacaggaatcataattctttttccaactgactacagtgcttgtatacttttaacgaataatcgctgtgagttgtacaaagccttatatattcaacaaatcagtgaagtttttatcctcttaatatttactttgtagctttgctttgaaccacctcagccccagttctacacagttggcagtaaagatatctgcaaattccactcccccatttcctttctgttttgcccttggtttttcaacagtgagatgattgtgccttcatttctgggtgcatcccttcacttattccttatttcccttctccatcccttactccttccttctcttccccaggccttcacaacctctagattttattactagcaacttcttaggccaatcccatagcatgctccttcatgcattacatgaacaaattttttgagggtgctgaaccaaacaatcaggtgtcttttttcaagagtgaacaagaagccactttttaaaaacagttttactgagatataatttgtattctataaaattcgcatttaaagtgtacaattcaatggttttcagtatatctatttagcagggcacccgtcaccataattaattttagaatattttcatcatctccaaaagaaaccttatattcattagcagtcactcatcaattctattctcccataccccacccctttattccctctagtcctagacaaacactaatctgctttctgtttctatggatttgcctattctggacattttatataaatgagatcatataatatgtggtcttttgtgactggcttccttcacttagcagaatgtttttgaggttcatctatattgtggcatctatctgtacctcattcctttttattgccaaataatatttcattgtatggatatttcacattttgtttatctgttcatcagttgatgacaaatgggttgtttctactttttggttattgtgaataaagtttctgtgaatatttgtgcacaagtttttgtatggaaatatgttttcattgcttttgggtagattcccaagataaaagaattgctgggtcatatggtaactctatttttagcatttagagggactgtcaaacttttccaatgtggctacaccattttactttcccactagcagtgtatgagctttccaatttctccacatccttaccaacaattattattttctgcctatattattatagccattccagtgggtgaaaattgatatctcattgtgcttttgatttatattttcctagtgacttttcatgtgcttatttgcatatttttctcttgaaaaatatcttgtaatcctttgcccattcccaacttagatcatttgtcatttcttattgatttgtgttttttatattctagtcccttaacagatagtataatttgcaaatatgctctctgattctgtggggctgttctttcacttgttggtgtcctttgaagcacagaagtttttcattttgattaagttcaacttatcaactttttttctcttttattatttgtgctcttgatgttgcatcaaagaaattactgcctaactcaaagtcacaaagatttactgcttaactcaggtcaaaagagttagttttcttctaaaagttttatatctcagcttcttttttttttttttttcattttttccatttttatttgatgtttccaaatataaaaaagtcaggattcttacatcaattatctcaaatgagaccatgcaaagcaattcagtgtatacaacaatcatttttccccttcagttctgctgctttatacaacagtgtgattgacagaaaattggatggcatgtgcctggtcagaaaatgtcatctgtttacaaaataacatcatgcagcacagtttctactttgtctgcaagtcaattcacaaaaactacttattttctgttttttatttgggaggcacatggaactgaaaaatttagctgcccaattttattcaactaccccaccaaaaaaaaaaaaaaaaaaaaatcacaaatgacagtcccaacactctgcaaattttggagggttgagatagtagacactatttgtcatactcagcagagttaactatttaacagaaataaatctccctagggcctttcctctcattttgctagactgggttccaggagaatcgtgaagaacccctcatgtaaaatttgaagtgtgaaaactgtgttgttgcattatgcagatttttgctagttgcatagactaaagacgttttgctaaatggcactgaaaatccttaccgagtgtcactattcagtccaagtgtttctgaccaaagaaaattatacaacaatatttataggctaactttaaagagatggttgacgttaatactgtacatattttacatgtcaaatacatagtccaagagtttataaaataaattcatgcatcattaccttattacctctaagaatatcatgtacaagatgggcactcccccacccccccagtacttatgacagcatttcaggtggaagcagtcttatatacaaaaacaatccagtttctctgctatgttaagtatataatttaaggaaatttcagagattactgaccaaaaaaatcttagtccattgaagatagaaagtgtcaatttgtgggatttaaaatgtttcctttataaaagaacacccagaatatgtaacctctgtacaaagaaaaaaatatacaaattctggatgatcatgtttgatcacactacgtacttgaaatgttgctggttaaaagttcttctgctttactcattcctttgacagcattaatttgtgaacatttatattcagttcagctgtatttatggcacaagatctcatttccaaaatggcactaattttccttaagtgtaacagcactctatttttagcagtaattatatttttaaaggttaatttgtagaacaaatgttttaactatactttttttctactctatactccccagttacaatatttacaaagggctgaagtctatataaaaaaatgatctttggctgggcatggtggctcatgcctgtaatcccagcactttgggaggtcgaggcaggaggatcacgaggttaggagtttgagaccagcctgaccaacatgaagaaaccctgcctctactaaaaatacaaaattagccaggcatggaggcaggctcctgtaatcccaactactcgggaggctgaggcaggagaatcgcttgaacccgggaggcggaggttgcggtgagttgagattgtgccattgcactccagcctgggtgacaaagcgagtctcaaaaaaaaaaaaagacatcttttactttcccccatccctcattttagtcaaacttctcccacctcatttctgccctggttggggaagtgcaagagtttcagataaggtacctatgtgttttagatgggattcttgattttaagtgagtataaagtaaaagatttaattcttagttcaggtatgttccagtgcctcgaaagttagttatgtgacaaatagtacctgttgacaacctagaaaagatgagacattctaaggtgccctaacaatcttcagtctctaacagctgaacaggaaggccatttcactcaactgtgatgcgatcatcactgactggcatttagaattagatttcaagactccactcctgtgggggccactaaataactgaatacattttaagagcaatctacactgagggaaataacggttctaaggtattctgcatagaaagagtatcgataatgggaactggcaactgagcatgctaaatcaaattccatgaatagagttttcataagatgtctttactacatgcattttgctaatatttccctaaaatattcaccaactctacagagttatactttgtgttaaggtactattgagttataagggaaatagccatatcaggtagctagtgacataataccagttgtgaaaattcagacaaaatgagtcgacaaatccccaaaaatggcaaattaagccctgtgacaaaataagttattggatcatacagaaatagcccaaatctggaaattttgaattaaaattgtaatcctgtaaaacaagttttggggtgaatggatttctttaataccaataatatttttaattcccaccacagatggatttgctgaatatgctaatgctgtgaatgagaaaacaattttggggtaggtatacccacaagtaatctgatgacaaaataaaccacagactgatgtcaaatggacaaaaaactgaaaatatgctgtgagaaatagacaaccaaaataatatagggggttgtggggtgtggcacagttaaggcatctaaacaaaaattccacatggctttggcttattaaaatattttacactatttttttaaaaaaagatttgaaagcatctgaaaaacatgcaaattgtttgaaaaccttgcatggcaaattcagacagtttgcaagcgtcaatcagatgtttgacgaggaaacgaaagaagcctctccccatgagactgcacatggtgggagaggcctacccagttctctctatcttacactagatggcaacccagaggtctgtgcagcggttacaaacaaggcattattatccgaagggaagggactgtagaatttccattggctggggaacaacccagctttagcttttccagatactctgcatgtacaggtttatgacactggagaactttgatagcatcttctactttgaaccactctctcttccttccaatattaacagaatcttcccaatcttctaatatttcagtgactgttagaacataaacatatgttctgtgctttcggtcttggttctgctcaaatatgcccagaagtctgcctagttttcctttgactccagcctcctcataaacttccctcacggcagcaccgccaggttcctcctcgggttccattcctcctcctgggacaatccactggtctgggtaccggctgctactcaccagcagcacctcgtcctcctgctcgctccggaagcacaggcacgccgcccgcttcttgaagccctcgcggtcgtaggtccgcgtctggttgggcttgaacttcatcatagaggcgggctcctgctgctgctgctgctgctccggccgccgccaccccgccggggagtgggggcgagggcgagtcgggcgcaggagcgcctgggagcgctagtcggtgcgggaggtgcggcgaggccggtcagtcccggggccggcggccgctccgacgcgggcgggacgggacgctagcgcgggtcactggaaccagggtgccgagatgaaagctccgcctctgcccagttgtccgccgctctccatggagcccgactcccgctcgcctccgctccctccggccgtagccgccaggggaagggcggctagaggcgcgcgccacgcggagacagttgcgaagacccgctcccactgagcagcagcaccacggcgactgtattttagcttctacatttaggcctatgattcactttgagttaattattgtgtacaatcttaggggtccaaattaattcttttgcgtgtggatatccagttgcccagcaccacttgttgaaaagaccattttttttttcccccattgaattgtcttggctctttcgttgaaaatcaattgattgtaactgttagggtttatttgtgattctcaattctgttccattgatctgtatgtttatccttctgtcagtaacacactgtctttgttactgtagttttgttgtaagttttgaaattgggaagtgtgaatccaccaactttgttcttcattgttttggcttttatgagtcccatgcatttccatatacattttaagagcagcagaaattgacaagttgattctaaaattcattaaaaaccctcacttctaagaaacaattaaaatattttctttccaacctaggatgaaattggataaggaggactgagcaggtacatttttgagttgtggtgatgggggatgggtcatttgaaagggggaccaacctgatggaggaggggaataaaggagccacaaagtttggtaaacttcccaccctggtgagaggaatgtttgttcagaggaggcagtttgttctaacaccagggaatattatgaaagataattgaaattgtaaagtccattgatatctccccagaagacaaaaaggtctctaagtaagcagtattgttagcttgttgattcttacagaagaagattttcatccaactaagggaagcagctgggactttctcagggctgtaagacagaaaaaaaatgaagaaatccctctgtatcttttcttacctctccctgtggccagccctaacttttgtccatttttgttacccttcccttttataagctccccaaaaagagagagaggagaaagagaaaaagaagaaaaccacagtgggagagagggttagagatcctggggatgggggaggaattctggagcatttcaaattaaagatccctaaggtactatgggtggaacctactaagtaatatgacaacttgtagcaagagtcataaggatgatcacatcttcaactcagtgatccaattcctgggaatttatgtaaggaaataagacaggcaaaaagtgtgagtgggaatgttaatgaaaatattacctataatagtgcaaacaggaacaacctaaatcaccaaaatagaagcatgttttatgacgtcatggcatgtaaagatggcagattataatactagcttcactgtcaaaatatactctgaattgcatcacttttcactgcattctgtatcactctggatcaagtcactattattcctcatctgaattattgcaatggcctcccaactggcatttctgctttcacccttgttccccacccccagtctactctcaacacagcacccttagcagtcctttaaaaacttaaatgtaaaattcatatggaatcataaaagggcctaaatagccaaagcaatcctaagcaaaaagaacaaatctggaggcatcacattacccaacttcaaattatactacaaggttatagtaatcgaaacagcatggtactgatataaaagtagatgcatagaccagtggaacagactagagaacctggaagtaaagccagatacttagaaccaactgatcttcaacaaagcatacaaaaacataaattgggaaaaggacaccctatttagtaaatggttctgtgaaaactggagagccactggatagaagaatgaaactggatccatctctctcaccacatacaaaaatcaccctaagatggaataaagacttaaatataagacctgaaaccataacaattctagaagaaaacataggaaaaattcttctggactttggcctaggcacaaaattatgactaagaccccaaaagcaaatgcaacaaaaatttaaacaaataaacggaacccgattaaactaaaaggcttttgtgcagcaaaatatataatcatcagagtaaagagaaaacccacagaatgggagaagatatttgcaagtatccatctaagaaaggactaatatccaggatctacaaggagctcaaacaaatcagcaggaaaaaaaaaaaacaaataattccattaaaaagtgggcaatttacatgaatagatgcttctcaaaagaaggtacacaaatggccaataaacatggaaaaaatttcaacatcactgaacatcagggaaatgcaaatcaaagccacagtgagataccactttaccccaaccagaatggccattgttaaaaatccaaaaagcgatagatgttgtcacagatggggtgaaaagggaacacttatacactgctagtgggaatgtaagttaatataacatctatggaaaacagtatgacgatttctcaaagaactaaaagtagcaatcccactgttgggtatctacccaaaggaaaataagtcattatatcagaaaggaaaataaatcattatatctgcacatgtatgtttatcgcagcacaattgacaatggcaaaggtatagaactaacctaagagctcatcaaccaattagtggataaagaaaatgtggtatatacatgccatggaatactactcagccacaaaaaagaatgaaataatgtcttgcactacttggatggagctggaggccattattttaagtgaaataactcaggaatggaaaaccaaatgccatatgttctcacttataagtgggagttaagttatgggtacacaaaggcttacaaagtggtataatggacatttgagattcagacaggggaaggttgggaggaaggtgagggataaaaaactgcatattgggtacaatgtatactacttgggtgacaggggtactaaaatatcagacttcaccactatacagttcatccatgtaaccaaacaccacttatacccttaaagttattgaaataaaaatgtatttaaaatttaaaaaagaaaacctaaatgtgtcatccactactcaaaagtttccatggctccttctcatttagtataaaagccaatgtctttgattagtcctgggccctacctcatctggcctccatctgtgacttcatctgatatttttcttcctgtaactccattctgaacatataggcctcctaactgtttcttgaatataacaggcctcctcctgccccagtgacttttgactcttccctctgcctcagagtctcttctcccagatatccattagtttgttccttcactgccttcagatctttgttcaaatgtaaccaatgatactttcttttcctgacaatcgtatttaaacttgctatcttcctcccatccctcagcctctagcatatcctgttcttccttgctttattcttccaacgcttatcattttacctgacttatttttctgggctgttgtctattcctccccctgtaacccatgctctatgagagcaaggatttatgtattttgctcactactatatcctcagtgtcttgactattcctggcacagagtagctgcttaataaataatttactgaatgagtgaatacatccacaaaaggagtgattatgaaaattgggtcataatttgaaaagtggaaagtacgttactgtaagctgtgatgtgcacagtggctgtggcaatgtggtgtagcatagtctgggagctgcagatgagagagatctggatttgaatcctgagtccactacttcctagttatgtgaacttcggcaagtgtacctaacctctcagttttatcatctgtggaacaggtagaataatacctccttcatagcatggtgaaaattaaatgagaagatgtaggaagaacctggcacataataggtgttctatgaacattaactctctctcttctcctaaagaatatatacacagtgggtaagaattgcaaaataattgggtgtttcaaagacagggatgatgcacttttataaaaaaattttaatacacaagtcctctctaagcatggatatatatataaaaacagtgccagactaggagtatggagacctgggttctgggttcacctctgatgcaggctgtgtgacattaagcaaatcctaacctcttgggactgtcttttcatctgcaaaatgaagaggtagaatttagtaagtttgagtcccatcaatgcttaaaattctataattcagaaaggcaggccattctacctagtttcatcccgctttagctcagccttactcagatatgctggccagatgtttctaatcttacacataaaagactctggtattcagaggccaaaagaaactggacaatttaagaaaagtactaagcagatgagttttccttctgtctgattcttaaacagctacatgacaattattcaaacttaagaaaacaggaaaagaaaagcaagtatgcacatttaggtttgaatcaactatgtgaatatttagccatgaagaaaaatgtgtttttttgtgtgtgttttattaattattatttgtacaacaaccaaaaagtagacgtcagcagttttcaactgtaactataaccttgtaccatgtggctgtgggccgaagtgcaggagggagtagctggaagggaatctggctagagccttcccctgctctggaaagctcgtggctttgtttttttcacattgctacaccgagacggaggaggggaggatgtttgggtttacaggccaccagccactgtcagcaagtttgtagccccagcttcacttccctgaaagggcgggggagtttcagctgccctggcctccctccagcaactgagccacagaggattcaaataccccatcagttgcaaggccctgactttacccagctgaaaactgactatctcatctgggaagggtcagttaaaaaatgacagaactgcctaaagtaaacaaagggaacaaccacaacagaaactttctctgcagtgtttccttataattaccggcccatcccaccagggctctggcttgagtccccatccactctccctgttgcccccacaggaccttgtttgagtaagccctagctgacctgaggatcgcctccctgtctacatgcctctgtcccaccctctccatggaggggagggagactcccgattgcaggaagttttgagaatggagtttgaggattgtcaggcaaaaagaccctctagagctcattcattaggacccctaatagatgagtaaacagcttaaatgaagtgcctaaagttgagagcaagtatgggacagaactggttttcttcttgctaaccgagtgctctttccagtaatcatatactgttgtaaggcactaaagataaggaaactaacattgaagttctttctccaccttttcattctaaccaaatcctactttgttggacttttacactttatagataggctgggcatggtagctcacacctgtaatcccagcactttgggaggtcgaggtaggtggatcataatgtcaggagttcaagaacagccttgccaatatggtgaaaccccatctctactaaaaataaaaacaaaaaaaaaattagctgggtgtggtggcgggcgcctgtaatcccagctactcaggaggctgaggcagagaattgcttgaacccggcaggcggatgttgcagtgagctgagatcatgccactgcactccagcctggctgacacagcgagactcaatctcaaaaaaaacaaaaacaaaaacagaaaaacacgctttatagataaacatattttgaatttagacttaaggacaaggactaaatcttacactctgtgtaccttgttcgtacttcagagttcatgaagtgtgttcatggtcagcagccaagtagagcgggtaggacatttgcttcagagttgagcaagcctcagaatcccatctctgcacattctagctgtgtaaacttgtaggcagattacctactctaaaacttagtttccacatttgcaaaaggggaacaataatagctccacctcattattttgtcatgaggatttcatggatgatacatgtaatgcacattgaaaaactcaacaaatgttagaaatggtaaatagttctggaaggcatttatcattcccattttacagatgagaaaattaaagctcagagagtttaagggctagagtcatacaattggttagtaagatagctaggatttagctcagcctcccagctccatatccacagtacttgctgccccaccattgagtgtagacaattgggggtggctctaagccatgggccaaatatgtctgtccctatcatcatggaatgacatgttatttattaagcccatatatgcttgaggtgccaggaaatggatgcttctggggtgaggtaggctcttcatgtgcagccttcatgtacagattccagccaaggaaaccaagcctggcactaatcccttgtccaagcccagagacgctgtgcccacggagtaggtcagaagtccttgaatatcctcagctttcctttcctctggcaatgcttccttgatgccctaagaatattttgcttaccctgacattagagccctcttcacactcccaagctttctagtattttgggtgtgcatctgattctcctgttgaaactggactccaaagtgaagtgctcaaaatggtacatagaggtatgagaaaaacatatgtgaatacttgcttctatttattttttaatctaaaatattaagaaaattaggctttactaatattaaaatgtcacagtagagtgtatggaatttatagcaaacatgcaattattaggcatgtatgctggttttcttttctttctttctttctttctttctttttttttttgatggagtggtatgaagaaaagagactagaggtaactgttctagaaagtaaggtcctacaggcagaagatgtgtctttttctaatgtgtattccacccctccctcattagcactaaatgactcctccctgattaaataaatttggcatctatgtaaacttggtggtctttcttgtttttcccctccttttgtcatccatctgatataatgtcttattcaatattctcccaagacctgaacaaataataaagctgtgttagtaaagagtgcaaattgccataaaaagactgaaaagtaagattcatagtccccaaggagatggttaatggtagtcaataaggcatatagcgggcaaaagaaaagctaaatgtaaaacttcatggaagaactcatggacacagtcaggcagggagccccagcactacagcctgagaaatcaaatgtaatctgagcatatgtgtgttttcaaactaaccactgccctctctctcctctgaaacttgcagaaagcaatgcaacacaatgcaatgagccagggtcttggagaaagaaagaaatcccaactctgtcactgtcctggttgggtgatcttgggcaaggtccataatcacccccactcccaggaaaaatagttcttcacctacaaatgaggttgagctaggtgattttggaggttactttcatgctttgaagcagcccatgttttcttcctgaggcaatttatacttcaagtgacaccatgaagctcactggaccaaaaatatcaccttaccaccaagcctttcatggtttgtgacatcctctcctcaggcaccgtgtctccatgcggtgcttcccaacctagcaataacttactggcatgaatccacttcaagtatcagttatgtccatgatgcatgtagagtgggaaagcaagatatgaaaggttatatatgtggtatgcgtatgtctataaatacctacaaatatatgtgcatacacatagaaaaagaactgaaagatactcagcatactttcaacactgattattcctagggagtaggaaagcaagatgaaggtatgaattttaccatttactttaaatcctcctatatttttgttgttttttaaaaataaatgattttactatttacaaataaaaattttaaaaaataaacattaaagtcctatacaaatgtttaataatatttgtaataagtagcaccagtttcttcaagaagccctaccagaagcaaatctgcatcttgatactgcattagagccttggctgaagtactaataatacccgaacattctatggaggattgggccctggactgggagaacctaatcacataatcagaaactcttattgagtaattttgggcaacttgagttttcccaaactttacttgagtttgtttttctcgactagaaaacaatgcttttgaactaaatcctctatcgggaactttctactctgaagtcctgtgattcttaacaacagtacatgcaaaagacacaggaaagtgagtatgtcatatggcatccaggatactttcccccaaagcaaagtgaaaactgatgtgaaactccttcttccttccttattttcctctctctctctctctccacctctgttatctaaatgctctatatttgaagcattcatcactttataggccttgatgggatacagaggacaaccttttactttagaagctgaaaatgtcagatacttgttttccagcttcccttacaggtatgcataggcataaggatctgcattgctttttgactcaggagctagtgacctcaaatagcaaagactgttgaatctgttctgcagcagggagtggcattagttgtaataacaacattcattttttagatgctacagtggtggtggttctggtggttctagcagcagggaccagcatccaggcttggggcattcactgagcagtggtttccatgcagtgggggcattgatgacttcatgatattgttctgcagtacaattttaggtgttgcttctggctatgtagcctctaaacctgggtttctagtcctcctggagagcttgtgaactacctaatattttttaataaattcatttaccgcttagattaactacaaattgtttctgttgcttgcgaccgaaaacatttactaatgtacctattatttttttaaaaaatcatgcacttggagattatatatatatacacacacatatgtttttaagggaaaaaaactccccttccctttgttgatcccttattttcccagtttcttctctggaggtagtaataatgatttgtttcttatgtattcctccagagatatcttgtgtgtacacaagcacatctatgtatttaagaaaagttacttaaaaatcactcaaataggatcactccatatacactgttccataatttgcttgtaaccttaagactacatgttagagataattccataaatataaagctgcctcattctttttcttatttttatttttagagacaggtcttgctctgtctcccacgctagagtgctgtggtgtgattatagctcactgcaacctctaactcctgagctcaggggatcctcctgcttcagcctcccaagtagttgggacaacaggtacgtgccaccactcctcgctaattttttattttttgtagagtcaggccttgccatgttgcccgggctggtctcgaactcctggcctcaactgatcttcccatcttggtctctcaaagtgctgggattacaagtgtgagtgactgtgcctggcctgcctcattctttttattggctgcttaatatccctctgaatgaatatactgtaatttatgtagccaatttcctcctgtaagcagttgggttgcttacagtttttgtgactacaaataatgctgcagtgaatatcgttgtaaatatgtatttttaaaaaaatatggaatgcttcatgcatgtcatccttgtgcaggggccatgacaatcttctctgtatccttccaattttagcatatgtgcagctgaagtgagcaagtaaatatgtcttaatgcccagtgcaagcagatacatgtctgatagggaagttgcagcgtcaaaaggtaaatgtaactttaacattttgatagatagcaccaaaatgcactgcaaatttagtaacaatttttaatcctactaaaaatattttagactcccccccaccaaatctttacgtcaccagtgtatattatcagattttataattttgctgttctaataggtgaaaactgattttctcattgttctgattttcattctttaatttatgagtgaggttgaacatttttcatgtatttaaaagccatttgtaagtattcacctgtgtagtatattcatgtcctttgcctgttgttttctattggatttttatctgtgtttaattgctttgtaaaaacttcatctttttttttttttttttttgaaataggttcttgctttgtcacccagactggagttgcagtctggcaccctcctgacttggcctttttttttttttttttttgagacaaagtctcactctgttgcctgggctggagtgcagtggcgcaatctcagctcacttcaaccttcgcctcccaggttcgagtgattctcctgcctcggtctcccaagtagctgggattacaggcatgtgctaccactcccggctaattgttttgtatttttcgtagagatggggtttcaccatgttggccagactggtcttgaactcctgacctcaagtgatctgcctgcctcggccccccacagcacccagccctgcctcagccttttaaagtgctaggatgacaagtgtgagccactacacctggtcaaaattccatattttaaagtaaatttgccttttgtcatacttgttgcaaaattttttcccaatttgtttttggttttctgatctttttaaatttgatctgatttttggtttttgctttgcataaatctttaattttcacaaagccaaatttgtctatatttttgcttatggctctggatttgtttggaatggcttttggctgggtagcttctcatggtttcaacattgaagctgctaatttagaaaaacaatacttgagacttctggttaaagacagcagattaaacacatgctccactccctcctagaactcaaccaaaatttaatgttttgattaagtgatacattcacatggttttaaaaccagaaaaatacaaagatgcacagcctgaaacgtttccctcatctatgtctcccatcagctcagtttccactttctccctgtccagaaataaggactgttatgctttcttatgcgtgtttccagagtttctttatgcatatgtaagcaagtaagaattttggtgagttttttttaaggagaaacctacaaggacaaaagaatataaaaaggacaagagtaagaaagataattttaaaagctggaacataaggccgggcacaatggctcacgcctataatcccagcactttgggaggctgaggcaggtggatcacttgaggtcaggagttcaagaccagcctggccaacatggtaaaaacccatctcaactaaaaaaacaaaaattagccgggcatggtggcgggtgcctgtagtctcagctacttgggaggctgaggcaggagaatcacttgaaccgggaaggtcgggggtgggggttgcagttagccgagattgcaccactgtactccagcctgggtgacagagtgagactgcgtctcaaaaaataaataaataaacaaataaaagctagaacatagatgaatgagtggtaactgaatcaagagacctgagaaagctgaatcctaagcctgcagatgagaaaggtaaagcaactcactttacatttcagaatcccccaaatgctcagcaattggtggcaccaggtacttttggaaataagggtgaagttgtggctaaaaacagtaagttgcattgaaaatcagttcaggaaacaatgaaagctccaggccccctcttcctcttgctgttagatggattgccccttccccacgatgtccaagaatggaggtttttctggtgggagagtaagacagagaagggacaaggcactattgtgtgaaaggacaacatgctgggaaaaaacaggagattataagcccattgccttctgccatcttctcttacttaggaaaccctgacagccagcctgaatattaggaaagccttctctgaaaccctgacacactggagagaaatgctccaaagataactcagaaatgacagcatctctgaaagaaaaagaaaacaagaagtattaataatatctccagagaaataagagaactagtgcatatatgaaataagaacagaatgctatgttttaaaaggaacattcagagaacaaaaaaaacttagaaatttaaatatgatagcaaaaatataaaaaagcttagtagatttggaaagtagaaaggaaagcagaaagataacagatagaaaataaaaaatatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaagaaaataaaaaatataagagcaaaattagtttatttgggagatgaccccagtaaacatctgtacgggagtaaagtaacgagaaaaggatcctacggaagttaatatatcttgcaagttactgtgaaccagtggaacttgactccatcggggaactctgggagacctgtgtagaaagcatgcttcagggttaaaccgcctcatggttgagcaagctgggatatttatctactaactctcatcagtcattggttaagggtctctcccagggaaaagggggttaattccccagcacttcctgagcaaactttcagtagctagaaaaagccctcaggcaaacagacatatgtgctggcagttttgaaggcctggatgttaagtgccaagagaatttgggcagggcactgatggcaaatgttatatcttccctgcactctctcttaggaaactactgaagaatgtgctccaccaaaacagtgttgtgagtcaagaaagaggaagaggcggaattcaggaaccagagcactcaacacagaggtgaagagagtccccaggatgtgggtaaagggaagtcccaagatgacagatgcacagcaggcctagaggtcagttagcccagagaggagcagatcagtaggctctggaagagctctcttccagatgaaactgatggaataccaagtttgtttggacatattgagaggagacttaaacaactacagaggagtatggattaaattagtggcatatgcatagaaaaactaggcaaatgaaaaatgagacaattattaactccagagaaagcaaaatagttttgaagaaagtgatcataatttattatgcaacacaggtgtgaatagtatttatttgatcatagtaatataaacactgagtgtcagtttaatagtgacgtagaaatataggcccatgtggtataggaagaggcgaaaactgaatccccatcttccacagtggaaagtcaatagagaaaactaagaggtagctatttagagatacaatgatttccctcctccccctaaaaaaagatttagtgaaagcattgaaagtgatttcctctgaggagtgggaaatgaaggggtggagtaggggaatgctgtttcttgtaattagtaatttagaaatatttgattctttaaactatgtgcatatttaactttgatgtttaaaaaaactaaataaaactcagtaatttttttcctttgctgtatgaaaaagggaggaggtgagatggaaaatgtacctcattcctagctgataagaaaactgggcaggcaaaatgaaacttgcttgttccatgagtccatcaacccagcagggtcaatgtcttttccatcttcttcagtcagaagaaaagctatgagcaactgggaaatcaaaactgaaattcctttgaaagagccattgatgccaaactgacctgaaatctggggctaccctaagagggctttggcctaaataaatggtccagggtaagtacaaagaaaggattctatcaaatgcaaaaatgagaccaggattatattaagggagctagtaacagcacttgagtgcaagtagaatacattcttaattatgtctaatatgaatttctttaaattctttaaaagccagttgttttaaaatacagaaattaaaaatattactatattgatttatagttttaattttaaaaaccatgggagtactttgtacagtcttttaattaaccgtatctatgactgaaattgcacatcgtttaggtctctggcccgatcatgataccagagtctgttactttctgattgcaggcaaaataactacaggaatgaggcctcctgaaggcagaatcagttctcctttctcttcctgccttcaatctttacctactagatccttctcctcagcctagaaaaatgcccaaaaagttccaatctaaaataaaaataaagaaggaattctcacttaagctatcacccaaactttctcttttccttcatcataatacttctaaaaaaatatgctaacttccttttcttcctttacttcctcaccacatactacttcttaactccttgtaatctagctttcactttgaccgttgcactgaacctgctgtctcagaggtctcaaaggacttcttacttgctaaatttcggtcctgcttagccctcatcctcctcaacctctctgtttttgactttcaaaatgtctcactgtgtctctctctgttgctctgtctctctctcttctctctgtctctctcacccacccaccctctagcccccttattctgtgttattcctctcttttggttttctctcctcccttattattcttcctttgagtcttctgtcccgctcattctcttaagaataggcatccaatgagatcccatgactccctgcaatatctgggatctgcctatgtctccaaactcatatgcaccctgttcccccttgttcatttcactccagtcacactgatgtttcagttcctctaatgggccaatgagctctttattaccttaggacctgctctctctacctgggacactcttccccatgttcccccacacccaaagcgcttcatctggctatttccaaatcaactttcaggtctcagcttcatattacttcctcagagtggctctccctaagtgcatcccctccccacccctccaaattaaatctgtttccccattttttctattttagaaatagtttttttatcaaattattatatggtttaaaatgaaagactacttgtgtgtttatttgcttaaatctctacctttctctccagagtgtaatttccatgaggacaggaaccatgtcagttttgtttaacactgtatccttagcattcaacacagaccttgaagcagcagacaacaaatattggttgaataaatgagtgaacaaagtgccaggcactacagtaagtacttcttcctgccaggcgctatggcaagtactttacatatatcacctcgtttttattcttaccacaaccctatgcataggtactactatcagatgaggaaatggaagcttacagagacagaccaatatgcccaaaatctcacagaaaaatgaatgtagctatcacgacgtgaaaagatgtagaggaaccttaactgcagattattaagttaaagaagctaatctaaaaagccttcatactgtatgattccaactatgtgacattctggaaacagcagaactatagagacagtagaaaggtcaatagttgctgggggttgtcctcgggagggatgaagaggcagagcacagaggattttaaggaacgaaaatactctgtatgatatataatagtggatacgtgtcatacatttgtccaaacccatagaatgcacgatgccaagagtgaatcctaattgacactacggacttggatggtgatgatgggttgatgtaggttcatcagctgtaaaaaatgtaccactctgtgtggggatgttgataatggagagggcctttgcatgtgtggggacagggagtatatgagaaatttctattctttctgctcaattttgctgtgaatctaaaactgctccaaaaaataaaatattttaaaaatgagtgtcagaggtaggatatgaaaacatttgtttgactctatgtagggcttaattataatattatactgcttcccagttgacaaatctaatactttcaccgtccaaaacttccctcacacttacttcctgttgtctgtttctatggtttctcttgagtcctccttccaggatccattccaagccagacaatggtatgtgggtgagaaactgtggtcatggaggagactggacagaccggaaagcttttcttttctaacacatgtttctgaggagccctcaggaagcctgtgaaccaggaaaaccacggtgatggtcaatgctctgacagctcccctgcccctttctccatgctcttctcctgccgtgccttccccaaggctgtgggttgctccccactgtgctgctccccttgggccttctctccctgcccacatatgcatgtgccagccctttcccctcacaaaaatgtcaacatagaatggtaagtagaaaaaaaataagatgcaatatcgtacaaatagttgttatgggttgaattgtgtcctcccaaaattgatatgttggagtcctaacccccgttacctcggaaggtgaccttatttggaaataaggttgttgtaggtataatcaatcaagttaagatgaggtcataatgaagtaggagggaacttaattcaaaatgactattatccttattaaaagaatgccatgtggagagacagacatgcaccaaggatactgccatgtggagaggaaggcagagattggggtgatgcagcagaagctgagaaacaccaaagacttccagaaaaacagcagaagacaggagagaggcctgggacatattctttctcacagtcctcactaagaaccaatttgccaacaccttgatctcagacttctaacctccagaaccgtgagacggcaaattgctgttacttaagccactcagttgtggtaccttgttatggaagtgctagcaagctcatagaaataacagaatcctgatcttgtaaagcaaaataaactcatgtattacgggttatcatcttgcatacgcacatacacatatacatagatgaacacatagaaacaatgaaaggcaatatattttaaaagttatcaatacttctttggggataatggatgctgagtaattttgctttgtacttttctctgcacctttgggtattttctcagttatcttacctctctacaatattatgcattattacctagaccagcggtccccaacctttttggtaccagggacctgttttgtggaagactattttttccacaggtggggcagcagtggggatggtttcaggatgaaactgttccactgcagatcatcaggcattagattctcataaggagcatgcatcctagatcccttccatgcacacttcacaatagggtttgtgctcctatgagaatctaatgcttccacagatctgaccaggaggtggagttcagggggtatatggcctggttcttaacaggccatggactagtacctgtccatgccccgggggttggggatctctgacacagacagatccccagacctcagtttcctcatctgtaatttgagaatagttataccaatcttccagcattgttgtgaggaataaagtgcctgacacaaataataggtcagtgggtcttcctagaatagggagagcagctccaaagaagtaaacctggacagacctctgtacctctattcatcatcaggcttcagtgttgctgctaagcaggcatgcggatgctgctcagcactggcctccctgtgtggtaagggtgggtgtgcagagatgagatggcacaggggagctagctggatgtcttgggtttgggaaggtcagcaaagaaaggtaagagagggtgaaagtttgattgaagaatgttggctatgtaaggacaacttaacccattggggtaacatttcttagtttgggttggggtccaatggggcaactgaaaaggaaaaaggaaccaagagaatagaaagcatagccaagaagcccaacaatcccctcctacaggaagaatgccttgcctcctcatttcttctctgaaacccctctggaaatgggagtggacaatgtaacttacttatcattttccacagcccatgggaaggtgttctttccccaggaggaatgtttcccaaacagccctccttctggccttatctgtgataagttgttcttttctggggactgtttgggtatccttgactctgacatactcagtagggcaggttaattctcttgaatcttaaatttagccatctgtgacttcatattaatctttggtctccaaaaacattgggctgttttgcctctttctactcacttatgtcttctttatcttaattccaaatcccagcaactcagagaagaattgggtcctgcaaatgatattcacaatctattgctttatgggaggtcagtgaaggcctttcccatttactttgttaaaatctatatctattttcattcctaattttttatctgcaagattatgtagcaacatgggaaacatttataatattaaatagtgaaagaaggggacacaaaaattgcatgtaaattatgattctatttgaaaaaaagactgagcaaatagacaatcaaaaagacatacacacatacgagaaaaataaaactggaagaaaacaaagcaaaaaatgaataatgactatggtaaagtgctggaattgtggattttttaaattcttctctatttacctaaaaattttaaggtaataagaaaatacttttataattaagaaacagacttactaaaataaagtaggggcagaaatgaggaacaaagtttgctaaaataaataaaacaggaaagcttgtagataaggttttatggaagtaaatatacgtagctcccagcttagtgtgtgtgagctgatggagaaacacgactacagagctcttatggaaagcatttaaccatttgtcacccttgcagtctacttcaagagtgactaaaaggaagaacaacatgaggaagacttcaaatgtgttgaggatttgagaagaggggctagaagtccaggcatgttagaggttttggggctgtagagagatactgtagaagttactaaattgggggttttatgggaagtgcttcaagcatgacattgtgaggctatgatactgtttatttttagaagtcctgttgagaggagtatctttcacctctcactaaattagctatgctccttggaaccatggacatctttctgctgtagcagcaataggatcaaagcacgtgtttagaaagagaagtgaaaaacaccagatgtgagcaaaaccacaaggggaatttcagacaggcagcatgcaccagatgacccaatttggaacgtggcccaggccccaggacaggcagaccctgtaaggatcaggctggacagtcagaggttattgatcccgatttaagccaaatgttgctaaaacttgatctgtgaccttgcttaagccattgacctcctctaaaccactttcaccatctgtaaaatgcaaggactgtgaatttcctctcaggaatagctaatggaaaccatgctaaaaagtagagataagaatgaagcacgatcttgcgatcttgaacaatggtggtaaattgtatttgattatataaataccacaacatacacacacttacagtgtatagatgcgcacactttatgagaagaatgtgtataaaaaacatagaattggccgggcgcgatggctcatgcctgtaatcccagcactttgggaggccgaggcaggtggatatcttgaggttaggagttccagatgagcctggccaacatggtgaaaccccgtctctcctgaaaacacaaaaattactggggcatccacctgtaattccagctacttgggaaactgaggcacaagaatcacttgaacccaggaggcggaggttgcagtgagctgagattgcaccactgcactccagcctgggcaacagagcaaaactccatctcgaaaaaacaaaacaaaaaaaccccatggattaaagattgtgttccatcaattcacagagtaaataatctatgtgttgacaattgaaggggtagaaaaaatattttttctcttacacatagctctttaagattcctagggccagattcagcatactgtctagcacagttagtgacaaatgaatgttagtatagaatagagattatgcttcaaatttcaactgtcttcaccacttagttgctatgtggctttgggtaaggcactctatcattttgtgccttggtttcctaatctgttaaatgggaaaaatactagtatctacctcatagacttgtgaagattacataaagtgatatatctaaagagcttagatgagtgctgggtggataatgttagttattactatcttctaaagtcttctatgtggacttcaaagctctctgcatttctttatttcatctctgttttctcatttaaatgtttcccacattcttgctccattcaagaatatttcttgtttgtcttattcatctatgtaggatattgctccctgtagactttaaaccagcttactcattccccctcaaagccattactgttttcctatttacgtcaattttgagtcagtctctaagttgaccctacaaccagaaatctatgaagcgtcactcaatcctctgttctcccactcctgggcttcttatataacaggatgtcctcttaaccacaggggatgtttcactaaaattaaaatgtatatctttattttctttaatagaagaagtaatcagttatggcatcacagtatataacagaaaatcagcttgggatcactgagcatggctgtctttaagaggatggggcagtgaaaggagtcctgggtgcagtgaaaatgccttctaccctttggagagatgttgacattggagagaaagagggatgcagtactgggtccaggaagggaagatgttggaattcatcctaggtctcatgtaccaaggaagtgactctgtatgagaacagaggggaaaatcaacaactgatcagtgataactatggtattttggccttagggctattaggggatgatgagggcaaaactgagaggaatgttagggaatcactttctctaaagtatcaatataaattgactctacttttggcactcacggaaacagcagaaagaggacatcacaacccctacctggacaacttctgatccagtttcaccaacaacagcgtcactcctttcgaagagcactcttgtcttccactgttaccttgtatgattatgtgattgttatcgtccttatcattatcactctcaaatcacttgaatttcttgcatccctccactatgttatcttctaaaataattttactacaagatgatttaatcccatggaaatttttgagcccctattatgaaggctaaatcctagggaatacaaagatgagtaaaagagtcattgctcttaaggagctcatatcacaagatttaggcagattgaaattgctaaccaacatttaacccaggtccaggtgctcctaattatcttccctattggtttgtcttgtcctgttcatttatttaacacatatttatttatttctttatttgagacggagtctcgctctgtcgcccaggctggagtgcagtggcgcgatctcggctcactgcaagcttcgcctcccctgggttcacgccattctcctgcctcagcctccccagtagctgggactacaggcacccgccaccatgcccagctaattttttgtatttttagtagagatggggtttcaccgcgttagccaagatggtctcaatctcctgacctcgtgtgaaagtgctgggactataggcgtgagccactgcgcccggccttaacacatatttattgagcacctactatgtgctaggcactgggctagcctaaggatgcaatagcaactaaaataagcatcatatttacttttagagaatataactgcaatgtgaagaattaggctcaatgatatacctggttgactacagaagaaatattaagtattcctgtctctcctccacagagtgggatgcactccagtgcactcctcttccaaccattacgtagtgaagttttagctgagacatatttagttcttatgtgagtccaacttgagaggcacctgacaataagaggacaaatctccactgtaatgctgaatagctggtagtctcatgtccagtattcctgtgcaaacacccttgcaggaaccaagtacccttcatattatgccctgattctatatgggttagacatacacatcaaataattttggtttgtcaataaacaatctaaataatagaaggtacagtcaattatataaagtttccaaagaaggataggggaagagtttccaagaaaagttttttcttattggaagaagcatatcagatgaaggcaagcattactttatgtatatatgtatgtatgtatgtattttaaggcagggtctggcactgtcactcaggccagagtgcagtggcatggatcttggctcactgcaacctcagtctgctgggctcaagtgatgctcccacctcagcctcccaagtagctgggactacaagcatgcaccaccacatccagctaatttctgtatttttttgtagagatgggggtcttaccatgttgcccaggatggtctcgaactcttggctcaactgatcctcctgcctcggcctcacatagttctgggattacagatgtgagccaccacacctggtggctcactaattttcactaatggcaataaaaccactacttacaatatcagagtgtacaactaatgtattagctgactaaataagggatgtagtaaatttagtcagggcttctgcctatatagagtaagaccccaaggcatggaagaatgactcactgtaataaactaagccaactaaatattgatgaatagtgctcacataacagcataatattagaacagaaaagaaaattatagattgtactggataactcattcaagcataaaatttggaatctgatggtcctaggttcaaattccaactcagcttcctctttgccacctctgtggccttgggcaacttgagtatttttaaatttgaatactacagatctatattcctagctagtagagttctttctcttatggattaaataaagtaatacaattgaagtcacatggtgcacagtgggcacttcataaatactctagtcttcttttcattgtacagaaaaggaacaaaagcctggaggactgatctaactttcctgaaggcccacagttaaccaatgtcagatccagatgaaagcccctggcttcctgactcctggtccagctggctgtctatgatttccaaaacagggctgtgccaaagacaactgaaaatacatttacctctgtttttttaaagctgaagagaatgaagtaaaaagagaggaggaggctgatgtggggtgagaggtataagaagcagatttactttcctggttttgcattaccttcctgagtttacactgcctgagcacacacccactaacggtggggggaagtggcagagcgtagccaacatgggattaaaaattgtgttacatcaacccacaaagtaaataatctacctgcccacagttgaagagggtgtaacagggtattgtgttttttctcacacatagttctttgggtctgctagggtcattccagatctaattttccagaagatcctatatacgcctttccattggagttttgagcttgctaatgtgtggatttggcagacaaatgcaaattaaagaagatatatatgaaaaatcacttgtagcctaaacatgatttctgtgtgggactggtgctccacatggataaaaaagccatgggccagagacaggatgcttgactgcttccctgcactgctgttaacactcggggggacccaagaaaggagattaacttctctgggcatctattttgtcacctataaaataccatcaagtagtcatttgctatacattgaatgcaagacgtttgtcacattttatttttctgtatccttttaagagcttcatggggcagattgtactcccacattacaagtaaagaaataagggcttagagatattgtgacttgtccaacgtcatttagctggtaagtggtagaatctgacagaacctggatttgaacccagaatctgctttcaacctccaagctacactacttaatattgtgagggagggaaaggatgttaaccttcaaagtactttacatcagtttaaacaaatgttcaatacaatcatttattaggggtataattcctaggaggtgcctgtacttaagtcattttcagctcattgactttctcattcattgcctctcatctgacctgtgagcctcaaaccacagttatcctatttcatttcctttgtttttggtgtcagtactcctcccacattggctgatttcagggggagccggcaccacttctcttcaagtaggggagtgtaagtgtaggaagccactcatacacacacacataaatatgcgcgtgcacgcacacacacacacacacattcatattagtttgtgatacacatacgtggtttcagaaattgacaatttaagaatatgtcattattatgacagtgcatatatcatgtataaataattccccagaattggggttgggtgaaaaaaacgctgtgataaggtgatagaaagtgaagagacatgtactaaggagaatactaagagacttagaaccttctggcttcagcccccaccttgaattttaaaagaagttcatgaattttttcctgctcattcggtctcctgaaagatccttacccttggtaggaaatgagcttgatacaacccagtgttgtatcaactgatactgagctttcactctgttatctgtatctgcattccaggtagtggtggtcatcagactgtaaactttggaggctcagggtcacatctgtggaattctctcttctgtggtccggcatggcatacaattagcaaattggtgatgacaacgtttttcattccttctattgctttttatttggtttgttcaggagacagacacaaaatattttgagactcatttaattatagcccacaactgtcatggcattcaacaagtgcagttattcgttaaatatgtacttgttgaacatcatggtactattattgaacatcacaataatatttcattttttgcattaacccttaatggttacaaagtgcatctataattagtgtcacacctaggcttcctaagaatcctttgagaagggagaaaggaataaaagcattacctaccttatgaggatttgtgagaatcatacaataaaagacaaaagtgcttagcactggaagctgatgcagcgtaaacaatcatgaaatgttactactagcacagttattagcccatattactgatgatatacctcacttcctcaagtttgcacagtgaagtagtagaattcagctaagaatctgtttccagaccccaaatctgtcttaggaaactatcagttgagatcgcaattatggaaggcaaaaaaacagagccttaaagggagagcaaacatgacaggttttatggtgggtgagtaggcagaagtgtttagggaccttatgtgcattgtcaagtgctcaggggagagggtgaggcccaggctatgtaccacaggcagctgtacaattcatttttggttcctcaaatgttctatcttccctcagcaccttcacatagaatgtgttccttctcccctgtcttattctctgtcttcacctctcttcccaacacttcacccaacattcacgcttccaggctcaacccaaacatctcttcttccaggatgctctccctgagcccctgtctgcacctactgacaggcactcacagtactctgcatgcctcctttagagaacagttgtccaatatttgtcttcccagctaggaggtaagcactgagaagtctgcaactttcccttgcttgccggctgatgtctccccagcagcagtgtccagcacgtttgtcaagtgcggagcagctgctggccaccttaaagatggaaaggaacgagactgaaaaaagggtgggaagtcatgaaaacaaatttaaaatgctttactattttgccctagaaccactcggggtggtgctattgggaagagctaggcagtgagaaaacataaaggaggcaacggaaaggagcgagaaaaaagacacaagaaaggcatggagaagtcacttgatgcaaagagtagcagacataggtgctcatcctgaagaaggctgggccatggatgccaagccttccgcagacatatgaaaggttgctgagaattagccgtttctctttctttcaaacttccccttgtttatgtctgccgtcttttgtcagaaagagatgcaggggccctgctctctccagaagactaacccctgcagcagtccatggaatccagggctaagtctgctgaggggagagggagggagggaagagtttccaccaggatgacatatttctgactctgccctctgacaacaaagggtgccggtggtgggacttttggcaggaagcacccacctttgggggagtcagaatcatgttgcggggtgacagtgactgaggcggaccctggagccctggccgtcttccctgcgcggccctaggcagcggtgcctggatgatctcctgggcgcctcctccgaggttcaggcagggctgagggaggatgcgatgcccgagctccggcagggcccattttgtttatgttcccactccttcgccctgggaagccccgagttcccacactcactgaggcaggaaggtcaccacggacacctcatctgtctgggccgttgactaactacagataagcagcagctgccacatccatgttggggtcacctcccagtctgcccaccctggaaccaggggagaagcccccatccccgcccacttgcacatgatgcctccccagcaaggtcagctgctcctgaggccaggatggcgacatggggccacagaaaaacttgcttttgcgggagaagcaagacatgactaagggattgaaaggtcttagacatgactacccgagagcccaggcttatatttccaccttacctttttttttttttagatggagtttctctctgtcgcccaggctggagtgcagtggtgcgaactctgctcactgcaacctccgcctcccgggttcaagcaattctcctgactcagcctcccgagtagggattacaggcacgcacccccacgcccggctaatttttgtatttttagtggaaattgggttttaccatgttggcctggctgatctggaactcctgacctcaagtgattcgcccgcctcggcttcccaaagtgctgggattaaaggtgtgaaccagggcacccagcctaccttacatttgctgagcactttagagtttcacagcgctctactgcctgcatcttttcacatgactctgaccaccacccgtgaagatcgcagagcaggtgtttttgtgtccattttgcagatgagtaaacagccccaggatgttcgagacgcttgccaaattcacacagatagttagtggtaaaagtcatgttcacgggggctttgtgctaccccatgcaaacacaccacaccagctgaacaatcccaatttttatccctaaaagaggactctttctcccaggtttaacctgttttccacccaagcctgccgtgtagtgagaaacatagcagttttggagtttgaatctgattcctcttcttgttaaccaaatgatttagcagttgtgtatttgggacttgatttccctgaatatttgcttccacatgtataaaatgcagataatgctgcctaacttgaacggttgttgtaaggtttaagaataacaagaaacatctattctctgttttccataccctaagcttggttctaagcaccttatgttcattgacttattaaattctcacaacatgcctgtgtgatttcatgcatgctatcattatttcattgtacagttgaggaacaatggcagagaggtaaagaaacataccccaggttacacagagagcagatggcagagccaggattgcaacccagactacagagccgagtgcttaatctccaagctatattgactatgcaaattatgtttactgtccacaatcggcactcaatcaacagctattactaagaattggggaagggtttgtttgaattacaagaaaaatgatcagctaactacctgaactaattagatgaatcaatagtcctgtctactcaaaaatattttctatgtagtattctggtttctaatttcttcccactagattcatagctttagagcacgaagtcacccaagggacttttggcaatgtctagagacatttttggttgtcacaaatgtggggtgctactggcatctaatgggttaggccagggatactgctaaacatcctacacagaagagttcctcaaaaaagaattatctggcccgaaatgtcaatatgctgaagtttagaaactactttaaaattgagtatttagagttgagtcatgattacttaagttttgaagtgccctgctggatccaaatttgacacatatactaatttgtttattcaaattggacacatataccagtaaagtaatgccctgtttaatatctagtgatacattaacatggttccttatatgtgatcatttgtcattacttattgttgctgctgctattgttaccaagcaaagcagatgtgtgccctagaaatggtcaggctgatttggggtttgtggtagagttagaaaattgaagctgtttttctgttaaattacgttaccaacctccaaattgctgacatttcttccaatatattgaagtaggtcataaataaactcacagcaatgccatttcctttcagcatacaactctatgaatccctggtatctttcagtgcagtcagctcttgttttgtgtgttatgtacacaccaaacagatttttaaagtttaattttgttggccccttttgaaaactcctgtagctaatgacattttcaaaatgataaaagttttattttgtcaaacagaactttgaccaacagaacacccttggtacccgatgcacgtgtggcgcatctgtgatgcctggcagcatactgaactttcttactttgttggaaaacactgcgtgtcacatcatcaacactgattttcatatcatcatgcattagcttcaaagactgtgtttataatcctcaaaggagttgtatcagtcagttttagccaggttgtgatacagtaatggataatccccatatcctaataacaaaatagatttgtatttgttcatgttacatgtacaccgtaaattggccactgattacttcatgtcttttgcattcttaatctagactgaaggagctggccctatttgggatatggtagcatcatagcaagggaaatgagaaagatgaaaccacatgatgggtcttaatagtttctgctcagcatatatgacatatgtttgccttctattggtcaatgcaagtccatggccaaattccttccataggccccataggcaggggcagcaaatattttaaacaataagataatctgctataagagtctgtttttgccaccaaagtcacaaacttctaaagagccagggactcagccttgaatcattgctttctaaagatgtttttatcaagaaatggggagagaatgtaaaatgaaaaagttgaagaagtaaaattatcagattctaatggttaatttgataaggagcagagttgggtggcaatgccaaggaaaagacagaaatgaaaaataatttctaagattccagcttgggtgactgataaatgatagtgtcaacaagtgaggtagagaagagagaagaaaaagaggtttagaaggagacaaaacaagtttcatttttgatgcaatgaatataaggtgtctttggaacatccgtgtagaaatatgcagtggacagctggatatacgagtgtggctcctgagagagtactaagctggaaacaaagctctgagatgcaagaccatgtaaataataataatcactattagggttgcatttattgactatttgctatgtgtcaggcactatgctaagaattttcatacaatttgcgtatgttgtattatttaattttcatgtaaccatctaagctgggtatatatatatatagtcgatgttatttatactcatttagctgatgagtttaaaagagggaagcttagggccgggcgcggtggcccacatctgtaatcccagcactctgggaggccgagtccggcggatcatgaggtcaggagattgagaccaacctggctaacacggtgaaaccctgtctctactaaaaatacaaaaagtagccgggcgtggtggcgggcacctgtagtcccagctactcgggaggctgagtcaggagaatggcatgaacttgggaggcggatgttgcagtgagccaagattgcgccactgcactccagcctgggtgacagagcgagactccatctcgaaaaaaaaaaaaaaaaaagagggaagcctaaaagttgatataatttagcctaggtctcacagctaggaagttgcaaaaaagatgcaagtgtttaatctgtgtaactgacattttagccaggtacagtctcagttggaaccatgacggcaaatgagaacatccagaaaccaaagatagaaagaaaagagaagagcagtgggccaagggcaggaccctaaggaatatgaacacttaaggagcaggaagaaaaagagcccttggagaagacagagaaggaacagctagagggagacttgaagagcacagtctcagaagccaagtgtgcagagagtgacaacgaaagggagggtctaacaaagtcagggataacagagtagctgaagagcagaccttggaaatgttccttggtgttgagagttaggtctgctccctgacagcatctctaatctcagggaagcatctgtaaccagcctattccccacccacaactcaggaataataataataaaaaaacacaggtggctagtcacacactgactttggaaacatcaacctgttgctggttcactctctgaactttgtttctcaagactgccttgaattttttacctgtctggatagatctttgtttctgggtcttagtgacctggctttcagtctctacctatgtacacttctctgaggttctggactgttctctcagcttaggaaacccagccttacaccacatccttatttttggttactacccactcccacctacagtcagtgaggttgggcactgaccctcaatccacagggctgtatctccagctgattctctgaaactcagcctccatacgggaaatgagttgtggtctcagctggtggttgctgtatctgttctgtagatgtagcaaatgtctgacaacagggctgctgccttcgagatcacaggttgctggtcagatttgccaagtcttgcactgcctgttgccagagcaagctgtctgtcttcaggtgggccttcccagttgccatgttattttttgtcacagctccagtagcttatggagatagaaggcttatatttggggaagaggatacttatgtaaatgggacttctcatgtcttctggatagtggcctggctatagtctggaagcccacactgtgtggacaccactgggactttctcatagccctgattgattggcaagagtccttgaaatctgtagagtaggcaactacagcatcagagtgggtaagtatccagacctgcctcactctcagagatttgaaccgaatgagccagtattatgaagaaaagcaaaaagcatctcctcgaaagtcctgcaagaagagtcccctctgatgtgagggcaccagaaacctgtagcatctctattatttttgtttagttggaggctgcacccacccatcagccttccctgaccatatccctcagtgagggttaccagacttagaagatgaaaatacaggatgcccagttaaatttgaacttcagataacaaatacatatttggtataagtatatgccacacaatatttgggatagatttatattaagacattattcaacatttatttgaaattcaaatttaattggtgttctgaattttatctggcctccctgtggccaccacaacacccataacttgagacttggtaggaattcataggccttgaaatccactggggccctatctctcccaagaaggcagtggagaactttgtgaggaagaaaagcagatgactgggcctctgctaggattactgggatcctaatactgtctggttccctctcctgggccagctcagaaggaccataaaattagatcttctgagtgcctagcaccttgtctgccttccatcgttgcatttggatgacagagagtttgcagagaacacaatgcctcttgacctatggcagcagcatgatcagtatcctgcaggactttcaaggggatgctttttgctcttcttggaaaatgtcctaatatatcctgaaacatccacatgcaacctgactagctatgcttcatacaatactctagccccaacagttctgagttacctgaaacatcagcaccttcaaaacagcacagaaatgtgtgacatttctgaaccaagttcagtgtagccagttatctgtgattctggagtgagagacaccctggtcactgaggttacctagacattttcaagagatgtctaacaccattttgtctttttctgtgcaactgccctagtaatgacctcctaaaatagagaaggaagtttcctgatgtgctgaggttgacactatgtttggcaagtcaagactcgctgcacctctgctccagtacagcacaagcaagcactgacgatgtgccaggcactgctgaaagggcttgcctatattaactaatttaatactcatgataaccctatgagctatatgctattattattgctgttttgcggatgaggaaactgaaacatggagtgataaagtaactcctataaagccatacaggtaaaaaatttactaagaatagaaatgaatgcaagcaactcagctccacagtgtgtcctctgcacctgcatgccagctctacacagctggaacctagcttcattcagcatcacactgttgagactggtgctgccaacactgtggagtgggccaccctgacccaggagaagctttatgccacacttcattatccctgcgtggaaaggggaagggcctgtggtcaagcatgttttcaagccctagagggtccaatgtgtgatagggacttcagtctgccatagcctgaaagctcagctcatgctatgcaaggcagctcaccttatctgtgcttgggtgctccatcagctgtgtgcccagcactcagaatcacagaccagattctctatcctgaaagcctgagtacaagaggtaacagagagactcgctctggaagactatggcttgagtatttcacaatcattctgctcaaatgatgtattttagacattgatgcatggtcttaatcctgatacagggcctcttggggcaatttggattgatgttaaatgccacgaagctcttcataggagcaaggcagtgctcatccctgctaggaaggccagaatgcagcctcagcacagccactggccctccctgaggtgatatggtctggtacactaccacaaaagcacctggacccaaagcaaagatacctcagggttcctctagagccgcggtgactccttctgatccacactcgcatctgaaactccagttttgggacttctatttgttgtctgcccacttcctggattgattgattgattgattgttatagagacagggtcttgctatgttgcccaggctgaactcaaactcatgggctcaggttatcctcccacctcagcctcccaagtcattgggaggtctgcccctcttgacctcttccctgactctgccctcttccctccctgcattgctcctccacccattccagtcatttataccctgataggtaaaagagggcttctactttcatggtctctcaaagcactgctttccaaccacagccctcagctgtgcctcagtttgggcctatcaggtctacatccacatacccaccacccctagacaggtgacaaaagtagtgcttaagaaacaaatgtgcttttttgcctcccccacacaactgactgctctggctaatatcactgctacacactttgctttcactaattattattgcctgccctccagaactgcttttttgcatacaaaggtttttgtccttagtgttttttttacacctcttcttggtattattattattgttttttatttttttatttttcgagacggagtctcgcactttggcccaggctggagtgcagtggcgcgatctcttgactcactgcaagctccgcctcccgggttcacgccattctcctgcctcagcctcccgagtagctgggactacaggcgcccgccaccatggctggctaattttttgtatttttagtagagacggggtttcactgtgttcgccaggatggtctcgatctcctgacctcatgatccgcccgcctcggcctcccaaagtgctgggattacaggcgtgagccaccgtgcctggccctcttcttggtattattgatattcctgcagctagacagtacccgggaaggaatgcaccaactagaaggagctttaatgagcctactgtgttatggctggcatcagccttcagagaggtttgagcataggatgccatctaattccccgccagcccattcattctatccaactaatgggaaaactagaggattgctgataataatagcatcagcaaaaatagttaccatttatcaagcatttactatgggccaagtactacgctaaatgctctgcatatattttctcacttaattctcaaaaaatgcaatgaggagaatgctattttatctctagctcacagctgagaaaactgacctgccaaaaaagccgcataatgaataagtgatagagcaaaattttgaacgcaagttaatttaaagcctgggcattcagccactctgctgccattatcatacatcatctgacttccttcatgtcccatctcccaacttctgttttttattttctcttttcctgattctccagttacccaccctagcagtggaggtgatatatatgaactgcatgccaaagtgggtgtagactcataatgacaacataatgacaccaactggaccatgggaaatggtgaaggcaagagtagttatttcaacttggccctttgaaacagagaccctgccgcaagttatgaggggtttaagtattttcctgtttcatttgcccttagatcccaaacacctagaactgtgcctagctcatagtaggagcccaagaaataccagcatggaaacctggaaagctggggtaaatctgatgaagagcacaggagccttagtaaatccgggtgatctgaaactggctcttagttgagccagatgataggatcttaatgacaattgtgcaccacttctcatttcttgcgactctttgcaggtttgcttcttgctgtcttattccaactaaaaaattctgtttacttttcatgtattttctctacctcagaattgttgcttattcataaattctgccttcttatcacatggttctgcttcctcatagttttggtttgctataatcctccatggctccactccattgtatgccatcctttcagcttcagctcccatggctaactgcttctttctatccatgtttcccaattcaaatcccagaaggagagaatctgattgatcaaacttaccttttccactcaagccctggtttttgggaaggcagcccctaatgtcaagggccaatcactggtccaatcaggagccatccctgggcaaagaacaacctacctctgcttctcaaagcagggggctctgggtggggcactttcatctcaaagaggaagttgggtgtggcaggcactgtgttgacatatccagtataggagtgccctgggagcccatctctcatttctgaaagagatagcattgtagatctggacgtttcatcacatattcccaggaaagcccagccaaatgcagctggtaagttgctgaatgtggaattcctcttggccttccaactccttgcactcttccttctgggactactttggtttttcagtttattacctgtttggagttggcttgtttctggactctctcttctgctcaggtgagcagacttctaactggaacgcctggctcttggacaaggtgagtgtttggatccaactttggttctgcaccattctttcaacttggatgacattgcctcacctcttgtatccttgtcctctcccttctactcaatccactctgctctgggttattatttacctgagggtgccttcccttcccagacccaccaacatactcctgagggaagaacattcaaaagcagctggtggcttcagtgagatcaatttttagaggaatgatcggggcagaagctagatagaagcaagttgaggaagtggaaatagtgagtgcaagacacttttctgagaagtttagatgaaaaggaggggaagaaaacagctatgtgtcaagagtttggtgtgtgtgtgtgtgttttattttttttgaaagaatttgcttcttattatataacacatgattttgtaaaacattttgaaaaaaacaaaaattataaacaatatgtttacaattgcccattaaactactacctaagtaattacaatagttaccaatttttgaatacctactaaacagaagaattatgctaggaacttcatgaattatttttctatttcttgtgcaatacaatgtcccagatgggtcagaattcagacagatatggctgtgatgcagaattagacaatgtctcttccctttaagcaatgattggcatccattgatttataagggggctgagaagtttgctgggggcaaaatggaaatatttgcctcagtagggtcttcagcattcatgggcatgtctggagacagttccagaggtaggcagagtgctggcaggaatggtggggcccctggagagagcaccgttggttgaggaaggagtttgtaacggtaagactgggctttagacctggaaggtcgtggtaagtctgactgtcacagggaagggcctaacccagcttccttgcatgtgtcttcccagaagaaaacaaagaagggcctctgagtcatggaaagagccatgaaactctttaatgctctagggcctatcgcccagtaactggtaactcagtgttatattaaggaagagagcttttcttttcccactttgaaagaggatgctgacagacatcacaggggctatcatagccctcaatttcccataaaaccggcaccacagtgccagctgtgattgcagaaaaaggtttttatccaagttgtgttaaggaaatagtagttgatttcagttaattcagtcataacactttaccttgagcattaatgctgaaaaagtcaactctcttacttcctgtttttcaaaagcattattggctagggtaactgtgcagggctccacgctgacaccgtttgtggacttttagctcacagtggtgctgtcagtgccagcatcttggtgtctggctaactataacaatacacatgatgacaacactggcttaagaacacaggtaagatctgtccaccaatgacacccaaatgtctttgtacaaaaacacctactcgatgaggccctccctgaccaccttatgtaaaaccgagcaacccctctgccttcctaccctctgcctaccccgactttctttccatagcacttatcatcatctcatgttttgtcatttttgtttctttttcttcttttttaatcatcgtttttcctgtcccaaaaagcaaatgccaagaaagcagtgtccaggtctgtctgtttattgttgtgtccccagagcccacatcagtgactcacacagagtgctcaatatttattgagttaatccatttcatgaatttctcataaatatttggggaaggataagaactatgaagatttttaattaacatgatcacatttggatttatggctcaggagaaccaaggatatttgcttacatttataccacccttacaaggtccatactctaatatggccactttgcaggtgaggaaactgaggatcagagtgaaagcaacctgcctcagcccccatagataataacgatcagagccaatataaactggtgtagtaagtaagaagacaaagtaggtagtattgctataggtaaagcaagagctaaggaaagccttagttgatatggcagaaataggaacagagagaaagggacagaaaaggaagaaactgtgaagcctgattagaaatatggaaggcagaattcaatatactcctagaagcagcccatgaaaataaaatgaagaaagaaggattgtttttctaagaggagggtggcttcaatttctttcagaaaagattggctaactgaaaactaagaaagaaacagaccaaatccttgtagcttctagcacatctatgataaaattctgttaattggatttcatacttggattataactgcacaacacatgagagtaaaatgccttaagacaaaaagagtaaaaattgagtcataatatggagacgatactattctggcaatagtattcaaagaatggaccagggagcagtgcacagctttgggaagcaggggttgtcaacattaggactcagagttgttagtgatgaggttcccaggcaacataagagacccttgaaaaaggctttggcttagggaaaaagaattataggggccagacgcggaggctcacacctgtaatcccagcactttaggaggccgaggtgggtggatcacctaaggtcaggagtccaggaccagcctgaccaatatggtgaaaccccgtctctactaaaaaatacaaaaattagctaggcatggtggtgtgtgcctgtagtcccagctactccggaggctgaatgacttgaacccgggaggcagaggttgcagtgagctgagattgggcgccactgcactgcagcctggggcaacagagtgagacttcgtctcaaaaaaaaaaaagaattataggacccaagtaagaaggtctggctcccttggcatttctcaccccctggcccattagctggtgttgcagactccactgtggtactccaaggggttttagagaaagaaccagggcagatgaccatccaaatcagaagggccaggtaggatggtcagccacacatgtgaggggcagatagggaaacagaagattaatgcatatgggaagccccaggaagctaaatccatcccagatcacactggatactggctctgttgaggcaggtggtggggggtcagcctggtgacagcatatttgttcattcaatcaatatttactgaatgctctttatattctaggcactgtgccagacattgggctaggtgctgggaattgaaataataaactatttcctgatttctcttctctcttctggagaaagaattggattagaacaaggtatggttctcactggcacagggattgggcaaggccgtctgcaagaggcagacatcagcttgggcaatggggtcaagttggggatggcaggccctggctgatacaatacttatattttacctgaaatctgtgtttattttctatcttgaacctggtattgtttatatttgataagcaaattttatgttttaagtaattcctagacatacagttaggacattttgcaggggagggcttttgatttttaatcctaaaagcattagtttgtctgtattgccgggcttgacaatcacataaaataagtgtatttcaaatcactcaataggagtggctgcaaataggggaaagaacatgatctattactactttggattactactttttactggcaaaccataaatcacagtggggaagccacagtggagtataaggaacttaaatcatggcaagagtgatttaaggtcagtcagtgcagcagataatctggagagatgatcccactcataaccctttaagacatgacacttggtaaactacctaactcataagggtgtcctggcagtgaacctccacacctcctggttggggtgtgtgctccatctcacccagcttaagtaggcctgaaagaccaccctgttctctcaggcaagagtattcctcttcattactggaagggaattaaagacaaagctggtctaatcaataaccgcaggcccttgtctcactgagaagaataaaaatgaatacgcaattatttgccattgtggaatgtgttttccctagtatcaatgctgtatgtaatactaagatttctacagcctatttaatatagaatatatacatacacgcacatgcaaacacatacacacagatatatatatatatatagttgcctcttgtatggtatccagtcaagtgtctttactgtaactggaaatcaaaattacatcaatagaaaaaaatgctacaccagtagaaaaggtgggggggggaataggagaatgaaaaaggggaggagcaaaaatgaaaattcacttttaaacaaatgtaactttggctatatggttacaggtataggttctggctgaaaagatttcaatgtctgctttaatgtaaattataagtattccagaagacagataattttattttactttttttttttttgagagggggtcttgctctggcccccaggttggagtgcaatggtgcgatctcggctcactgcaatctctgcctcccaggttcaagcaattctcctgtctcagcctcccgggtagctgggactacaggcacccgccaccacgcccgcctaacttttgtatttttactagagatgggatttcatcatactggtcaggctggtctcaaactcctgacctaaggtgattcacctgcctcagcctcccaaagtgctgggattataggtgtgacccactgcacctgggtgacaagataattttaggagccactttaaaaagtttccggaactgtagtctattatttcagtctcagtcccatacaccatgaaaaatttagggcatttcattgctacaaagaattttaaagcagaatcaatccatgtaattaaatcttaacatttattaagtgcttattgtatatcaggtacttttacttttctaatcattgtacagttattaattcattcaaatcttacaaaagtctatgagttattgtttccattttacagatgaggaaattgaggcacaaatattgcccaagatctcacagttagtgattgacagtaagattcacactcagaccatctgactctggaggccacacttgtcattcatgttaatcttacttaacatgcttcatgctaactacagacttagttatctccatatgcatctttcaagtagatggcttatcacaacagcaattagacctgtttacatgtttggcgcttatttattgaatgattacctactacacactgaaattggttaagtttgtttctaaaactgacaagctttgttttaaaaacaattcatcttcttccgctctttttttcacaagaggtagttgtttggatagtaaccttttgagaaccaaaagaagtgaaggagagctacttttgtgagaatgaaaggtggagggtcattcattcaagaacttgtttttaccaggtaccagttgtcagtatgcaaaagcagcgaggtatgccaatgtaattcatgttcaataaacatcataaaatttatttctatacattaaaatcttcctgtgtaacaaaatgcatgttttatttttatctgccacttttcttaagtcagtagacaattccctcttctttctcccaggcttgatatgaggttagcttttcacaattggtacttctgggggggcaaaaaacaggcaaaataagtgaatgggaaagcactcagacttattatttattaatttgtgatattctagcctttcagtgactcttttcatgctattttttccaacttctgtgggatggggaaaaaacttatccggagtgacaacatttctattttccattattatttcttgcataaaatattcaaaaacaattgttttggcatcatctcacttcgaagataaagaaagcaatagtaaatatcagcctgcatattgggaattcttctagagaatattatttagacttcatgaaacaaaagaggagctaaaattatgctttgtgtaaatctcagatagtggttttggcttaaaatttgctatcccagcactttgggaggctgaggtgggcagatcacgaggtcaggagatcgagcccatcctggctaacacggtgaaatcccgtctctactaaaagtacaaaaaaatgagctgggcgtggtggcgggcgccggtagtcccagctacttgggaggctgaggcaggagaatcgcttgaacccaggaggcggaggttgcagtgagccgagatcgggccattgcactccagcctggtgacagagtgagactccgtctcaaaaaaaaaaaaaaaaaaaaagaactttctgttgtgttaaagttaactagcgaggagactcttgattcctaagaaatattaaccttatatccccaaatatatttcatgtgcagttcaacaaatgaaagttaggtgctctgaataggttttggggttaatgagtctattagaatacaggctttttgtatagcagcctcggagagctagcccagccaggcccagtttctgctgtttctcaagcacaggaggctgagagtagagaaaagtgctctgtaagaaggctgagcccctcactggaggtggaactactaccctacatgttttgtttgtttagatgatacgctgagaaccaaatctaccctgtcagcttactcttcaagaacaagccaagcaactgaaactgagtccacgctcagctaagtcaaagcccaggggattactggcatcaccacccaccccacctggagcatgacaatgtctgtgagagaataagagatgggtggtgtcaccactatctttctctttctgttctccaaattataataataacagtctcttttcctcctctaaacattttttataaaggaggttgaactcagttgaaatatcttgaaattactgtggctggtttacaagccactctggaaagttatgctctggcataaatttagcagctatgttttactgtaaaaagaaacccagggacatagcttattaagaaaatgtggtcaaagtgagaattttctttggttttatgaataaatatagatattatattacaaaattagatttatatcgttgagcttgatactagacagtaaatattatttcttaggaaaaggttaatacatcattaaattttaaaagttgaacacaaaatctctaacaaattaaatttaaatatttccatttcaatatcattgcagacagttcatggtagtgaagtacattgagaaaacttgttctttaagaaaacaaacttctgggtaaaagatagtaatatatcagcaaaaaaagatttttatcaagagggttgaaggctatagcatcatcaaggtaaagatcaaatagcatggaggctaaaataaacctgtgcttttttgagcgggtggtcaatagaaattggctctgttgctggagatcctgaattttaaattctggtgatcaggccagtaatatgctgatgaagcagaaatgtcacagcatattttaccaagtcaaagacaggcaacagttatgagagggacatggagaacctggtagagctctgtgtactatgctgaattaataaatagagaactaacttaaggtggacaaaactgctgggtgtctctcaggcttctaatgttttcaaaatgtatttgaagacttaaagccttataataataagaagaagagtagtccaagttctgtttatttccttttaaaaggagtcaacacttgaggagacaattctgtactcccacaacaggaaaaatgcatccttttaccgtgtgaataattgaaccagagtcattgcccactcttcaggaaatagctcatgtaaacttttggccgacctgtgcttcacagtgcacttacctcttgacatccacctctgtaaacttttatttgtattaccaaatattgactgcaaacaaaaaaaaaaaaaaggaagaaaaaggaacctcccttatacaattacagaacgttagagcaaaagagaactgaaagatgatcttgtgcaggccaccattttatagatgaagaaacaaaagcacagagtgacttgctaatgcttcaccaagctggcacagcctggcctagagctacattcccctgtgtcccagacccacatgccagcaccaacatcatggatcctctctctctctctctcttgtgagacagagtctcactctgttgcccaggctggagtgtagtggtgcaatcttggcttactgcagtctctgcctcccgggttcaagagattctcccgcctcagcttcttcagtagctgggactacaggcatactgccaccatagccggctaatttttttgtatttttagtagagacgggatttcaccatgttggccaggctgaagatcctctctcttattgcttgatgaaaaaatgtattaggcactgggaggatagaaattaaagagccccaatacttgacatctaggagctcacaacccaataagaaaagtacacatgtagaccaccctccaatattttactgtactctgtacactgttgctagaatgatctttctgaaaatacaaattgtaatgtatctaaccctgtgtaaaaccgtgcagtggctccttgttgcctgtaaggtaaagctttccccttgttctccagccttctgtctaactgggtctatgctgatgctcaggatccagccatagagaaccaattgcttttccctaaatatagcaggcttttccctaaatatagcaggccctttcatcctgccaggcctttgttatgctgttctctgcctggaatgacctcctctcattaccctccaggagggttatctctcttgtaatagatttccttaggtttctctccttccacctccaaccccacagacagaattaaccattccttcctttgtttatttgtcctgcccatatttctcctacagcacctatagtgctttgtaacattgatttttttttttttttgagacagagtcttgctctgttgcccaggctggagtgcagtggcgtgatcttggctcactgcaagctccgcctcctgggttcacgccattctcctgcctcagcctcccgagtagctgggactacaggcgcccgccaccatgcccggctaattttttgtatttttttttttttttttttttgagacggagtctcgctgtcgcccaggctggagtgcagtggcgcaatctcggctcactgcaggctccaccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggccaattttttgtaattttagtggagacggggtttcaccgtgttagccaggatggtctcgatctcctgacctcgtgatccgcctgcctcagcctcccaaagtgctgggattacaggcatgagccaccgcgcccggccgattgttttaaaatacataaatgtacttgccatttacacttatgtctttctctactaattgaagataagctccttaagagccatctttgtaagggccatctttatctttgtacccctagaatctagctcagtgcctggctcagaacaactccattgaatgaaccatccatacaggcccttacatcatgctatgggaatgcaacagaaggagcagtgaactgtgcttagaggagttgccttggaagctgaagcatgtataccaaatagaggaacatcagggcagggcaagggttggttcatagctggtcgccagaatagaatgctcaaaggtacaggggcctgagaagtggtggaaaggttggcaggtttgggaaatttgaggatacctgagaggatggactgtgggatgtggtggtttgctgttattattcttattgttaaaccagaagaagaggctatgagttagtcaggggctgtgtgttaaaaggcctggcaattcatgctgagaaaggagttttgattatattacaaagagctaaagaaagaagagttttgaaggtcagtattcaagagtagggatgattggatatgcctgtcagagacaaaggacaatgcagtgaccaggagaggttgctccagggaggagtgggactgcatcttagagtctgggtggggcattggtgatctgagggttcagagaactgagaatggtccaggtgaaaactgatgagggcctgaggcaaggcagtggagatggagaaaatgagaatgattggagaaataaacacagcagtggtggaatggtgactggcaatcagctgaagatggggaataaagggaaatgaggagtcaaaaatgatcccaagtgtttatcttgaatgtttaagcagatggcgttgtcctgatatggaatgcagaaaaataacatcgagttgagtttgtgatgctttcgagatacttaaatgaaaatgttgagaaagcagttgaaattacatgtctcatattcaggaaagagttgagggcatgagtctctctaggtaataactgattccataggacaggatgagagcatctgagagcatgtgagggcgagagaaggtctagaatgaggccctcggttaaggaggagagagaggagaatgagacaacaaagaaatccaatgtggagtcatgagagccatagaaaaagagtttattcacagggaagaaagagtttgtagtgttaaaaatcaaagaaaggatatagattgaaaaaaaggtcctgaaagaactgtaatataaggctacaaacatactcattgggggctggaggaagtccaacataagccagccccagcgttgagccagtgaatcggagacaaaaggctccctctcttttttagtcccagccagttcataagcctgaggttgaattgcaactatgatttatgctaaatagctttatctaattagggctggtaaaattgaagtggttggaatacctctggcaagaacttgataaaaatttgagagtctttcacgttaattttaatcttcgtttgcatgaaatgggatggttaaggagaagtaaaagaaaaacatgaaaaggaaggcacaataagaagcattcattctttaaaggaaaatggtgtaccaaagagtcgtcccagagctcttccttctcctgcctccacatagtctaaggtctgtttacaggaaaaacctaagctagcgtggccaatataggttttaatgggtgagccaaaaaaaaaaaaaaatgctttcatggcaaaaataccaaaagcaatttcaataaaagcaaaaattgacaaatgggatctaattaaactaatgagcttctgcacagcaaatgaaactatcatcagagtgaacagacaatttacagaatggaagaatatttttgcaatctattcatctgacaaaggtctaatatccagagtttacaaggaacttaaacaaatttacaagaaaaaaaaaaccccattaaaagatgggcaaaggacatgaacagacacttctcaaaagaagtcatacatgtggccaaaaacatatgataaaaagctcaaaatcactgatcattagagaaatgcaaatcaaaaccacaatgagataccatctcatgccagtcagaatggctattactaaaaagtcaaaaaacaacagatgctggcgaggttgtggagaaaaaggaatgcttttatgctgttggttggagtgtaaattagttcaaccattgtggaagacagtgtggcaattcctcaaagagctagaggctgaaataacatttgacctagtaatccaactattgagtatatacccaaaggaatataaatcattatattataaagatacatgcatgtttatgttcattgcagcacattcacgatagcaaagacatggaatcaacctaaatttccatcaatgacagactggataaagaaaatgtacatacataccatggaatactacgcagccgtaaaaaggaataagatcatatcttttgcagggacatggatggagctggaggccattatcctcagcaaactaacgcagggacagagaaccaaacactgcatgttctcacttataagtgggagatgaatgatgagaacacatggacacatagggggaacaacacatgatggggtcagtcagagcggggtgtgaggggagggagagtgtcgggaagaatagctaatggatactgggcttaataagcaggtgatgggatgaattgtacagcaaatcaccatggcacacatttacctatgtaagaaacccccacatcctgcacatatacccctgaacttaaaagttgaaggaaaaaaaaaaagtaaaaaaatgccatcatgatacaattaggcacttataaaaaatgtgttccaaatccctcaaaagtgttttagtaaggggcttactaagtatggagatttcaaatgtggtatgtggatggtgctaaaattgagagtaagcatttagaaatttttagagcaaatcgagaatgctgtaacatacaagcacattgtcagtggactcatgtcaatgagcagggtatggactggtctgggtgttgtggaattctcatagtgagtcacaggtggcatgacctgtgccctagtcatacgcaggaagacacttagaccacaagcttggaaattaaaaaaaaattaaccacacagatagtttgaaaatcactgctttagatcacaacctatttgtaagttaagaggccctacagctcgtttggtgcaaggaagttgacagagagcttgagcatacaccaaaaaatttagatataaagtgacgggaaatttgaagccattgtagaagatacgaattggagatggaactacccaaaattaccttctataaggatcttctagattaaatgcaagctaacttattcttaaaattgttttgttcattatgatatgaacagagtctatatcagaacctggaacatggcaggcactaaataaatattttatgaatattgaattagttgttctaacaacatcgtggagaatagcttgagaagggtaaaggctagaatcagaaaaagtggctaggaagactttaaagactgtctagacataggttgatgggtggattagcctagtggatacagagattcagaaaatatgaatctaagaaatattgggaggaacttccagtttttcccatgtcagtaagcacatggacattcatcaaagtccaaatcagaaatgtggggtcatccttgactcttctctttctccttgctcctcatatttggtcactctctgaatcctaaatatcgctaccctgccttctcctgctattcacactgctttagttcaagccccaccacgtccctccaggactttgttatagcttccttaaatggtctccctgccctgggttcttccccattaagcttttcttccaaaattgaaaattcagtgtttttccttttttgtgtgaaaccatgaaatggctcctgatttaccttctaagcttcagcatacctaagctccatggtagggctgctccttaccaggccttgtgtcatctggcacttgctttgcatgccagtgcattcttctgctccttacttggtggttcttaaaccagaccaacactaaacaactggtaacccctgccccaagggtttgccatgttatttcatgcctctgtgcctttgcttatgctattccttctgcctgaaatgctctcactcccagcaccctggctgcttttccatctgtattcatttcctgttgctgctgtaacaaattatcacaaacttactctttttgaggtcagaagtctgaaatgaggctatttcatgaggctaaaattaaagcattggcagaccttcatacctcctggagctggaggagagacactgttctttgcctcttccagcttctaaccacagtttttgtttttgtttgtttgtttttggttttggctgatggtccctcattgtcacatctctttctctgacactcctgcctcctttttctataaggacccctgtgattacatcaggttcgtctgaataatctaatcttcccatcttccttaaacgtagtcatatctgcaaagtcctcattgacatgtacggtaacatttacaagtttgggatgtggatatctctgagaagccattattctgcttactgcaccacccaaccccaattagtctcttaaagctctgctatcactttttctctgaaacatgttctgctcagagctaatcactctctattttgtgtcatatacatactaccttcactgcatgggttggcttgtattgcacataataacttttaaaacacatctacctctctattatattttgatttcttgaggggacagcttatttatctttgtattaccagcggtaagcatgttacatggtatatagcaagtagtaggagctaaattatactatttaaaaatgaatgtcccaggcagtgcaatgatccatttgaatgttaactagacatgtaggtttaaatggtgactacagttgtggtgcattcctaactttgcagggtcgttgcctaccactctccctgcccacgcttgtctgcttcccctccagtcacatggcctttctaaccttccttggtcatgctgttcctatcccatcctcatctctctgtctgtaatgcccttcctccaacttttcttttcataaatccctaattcattctcaaagcacaaatcaaaactttttccttctgcaatgccttttatttgtctcaagacagaattcatcacttcctcttttgagttgctaagacattttgtacagatctgtattacatatttcacattgtgttttgcttggttttatatatgtatctgttccatcacaagaatgcacaaaagccatatcttgtttatatcagtactaggcatatagcaagcactcaataatgtttatgaccttaaagcgaacatataaacagatgagaatggaggggcaacagaaaggaaccaaaagattaaaagagtgcctttgataaaagataaagaggaaggaagagactgagaagaccctcaaagacagcattcagaagaccctagaggcagagtgtgatgaaggctggagttagagtggctgacctctaattaaagaggagaatgtgagaggcagcaccacatgcagtgagctgcaggcctgagaaagagaaaggctgttggatgtgaccacgaagagatcctaatggttttaggaagcataatgagaatgcccagtcaggaccctgggtctgctcctgtttttaggttaggagagattaggttaggttaggatctccagaggataaatgacttgaggaaaaggaatatcacacttcatatccaatcaacttgcttgaatgcttgaggccatgaacacctcagcacagctccaagtcagtttggaaggcttggttctttcatctgataccacgacttcaaagtactaggagatgtagatggttctcagggaatacagaggccaacataatgtattcccctataataatcagagattttcatcaatagggcacagttggctgggtggtccaggctcctgaggaacaaaggcaaaatgtctaaatctggcttcagaactgagaataatttctctttcacggaacttttctggatgatgatatttctctatataaagcattctctgacccagtggacaaatatttctcacatctctgcctgccttgaaccttgccctcctatcttccatcaacactgctgtcagctgtattctccaacctgtgtcttgtttggctaacctgtatggccaactgtctgtctttacctttacaaagcctgatctagacaaacttctatgctggacatctgcactgattttcgcccaaatcaattgtctagcatctatttctgtgatctgcttctgctgtgtcctgaatcagtctgctgtggtctgataggttgcacattctcaatgggagtgagaattgatcttgggggataaaaaacaacttaattttttaaatgtacaaagtgcagatatacatacaatgcataaaccgatatcacaatatatctgcgtgtattagggctctccagagaaacagaactgatagcatatattatatatagatacacagaaatagatttattacgagagattggctcatgcaattatggaacctgtgaagtcccatgatcagctgtctgcaaattggaagcccaggaaagttactggtgtattataactccagtccaagccagaaggcctgagaaccaggagagccaatcctgtaagtcccagtccaagtccaaaggccccaaaaccagaaacactactgatatccaagggcaggaggagatggatgtcccagctccagaagagagagtgaacttgtgcttcctccacctctctgttttattcaggccttcaagggattgcttgatgcccactcacactgccaagggtgatcttttattcactctaccaattcaaatgctaaccttttccaagaacaccctcccagacacacccacaaataatgttttaccagtgatctcagcaatccgtagcccactaaagttgacacacaaaattaaccatcacactatggtaccaaaatttgatagaggagagcaatttttaaaaacatcggaaaagcctccttaggaaggcaataatgaaaagaaaagggttgagaaatattgtgataggtgatgaggctgcaattcctgtaacagaaggaacataaggagactggattgtgaggaaatggaggtagtcacagttatttgactgagaagtagactacagagagaattccgatgaagcaaacaaattatgagcacttattatgtgccatgaactgtgtgaaaccctttcacatttgttagcaaagagcttctcctttagtagtaatgtacatattccttgcagaaaaaacagtgacattttccattgagacagtagcgcacctatctctcctctgcttcagcagcctttatgctaattactgttttggaagtaactcctcattcactttttgcaacataagataatgagaaatacagcccagattttgtttgtagaagctcctttcatggcagcctttcaacagtttgggtaatttaaaagatgcagttgtaatcgtgactaactcattaagatgcttgatgagcatcttaatgagttaaaaaacctggacatttttaacgcacttttggaaagaggcaagaaaaatataagagtgggaataatccaaggaaaacatttcaagtctttgaacaatagaccctagaatttccttagcttgagataggttaggacaagaaaacagaatgttgcttaaaagaagcccagtgatcatttgtgtctacttgcacttctggaatatgacttttgtttgttagttggttcattttgacttaaaaagtgtttttcggccaggtgcagtggctcacacctgtaataccagcactttgggaggccgaggtgggcagatcacaaggtcaggagatcgagaccatcctggctaacatggtgaaaccccgcctctattaaaaatacaaaaaattagccaggtgtgttgacgggcgcctgtagtcccagctactcgggaggctgaggcaggagaatggcatgaacctgggaggcggagcttgcagtgagccgagatcgctccactgcactccaacctgggcgacagggggagactctgtctcaaaaaacaacaacaacaacaacaacaaaacccacaacatttttctttgttctctctcagtactcattaagaatttactactgcgtctttagattttatctcaggcagatcaatgctatgtatttgtcccctgtacttgatccctgtgctttccttctctcctactttcctactcttgtcatgagtgctgaggcagggatgatgttggggtggaaagctgaagggcgaagatgaatgagccacagtgtccacttagaatctacagccaactcttggcagcttatccgtggtaattcttgtttcagcttcttgttgactttatcacccactcaatgtgcttaattctatgatggatgttatcaccagctctgtttattcacaatgccaagaacaccagtggaacagggaaatattcaggaaaacccactttatggtgtcaacttgaccagaaaacgaaacacaactccatcattgctttattgaatttggcatcgttctagaaataaactatcatttatattttgtcaaacaaaaagaagaggagaagagatttcaaaagcactgcttctggggagggtctggatcaaaggtaaatgtgtgactttaggtgacagaaaagcatctccactcagatgcatccaactttgagggggcactgactacaggacagtagagacaagggacactcatgaacaagcagcttttccaattctgggtccttttcaaactgtagtatcaacatatatttttaagtttcataaattcttggaacattaaacatatccattcaaacagttctttcaatatggtggatatttgtaggctgccctggaaatcagaacaccttgaatttaattcctgctatgacactggctgactctgtaactttcaccttttttagttctccaagatgatataaataatggaaaacatataggactctaaaatggttgcaacataggttcaaatctgacccctaccacttgttagcttgtcaacattggataagttatttgacttctttgagcatcagtatctttatttgttaaatggagataaagatatctttcttgcaggaatgttgtatggatctaatgagatcatgtatgcaaaacacccaacacatagttgtcactttataaatggctgttctagtagccatttgcacagagatggggaaaggctaggtgacaaaaggcatgggcattctgagctcatcagttgatagggcttccttaatgccatagctttattagagaaggaggaggatacagcccagccacataggaactcaggcctcttttatttctgcaggatctggtcaccacaacaatcagaatgtgcaggggtaagactaaggaagagagagagaggaagaatggatggtgggggggggggcggctctcttcttcctagcggcagagaatcccgcagtattccttcagttgcagaaactaaatggaaggcaaatggctgtctgcttgtggtgcatgcaccaagacaaactactaaagtgtttcctgcccagtccccacaggtgttgcttctcagctttggataagtcctccagcaagtactttgttgaaagcgagaaaggcagctgcataactctccagtccacagagctgacaaatcactgtgtcatcaaagaagagggaatcatgggaaatagcctgtggttcaccctctaaggcagggagtcaggaggctgtgaggtggcacatttgattcttgctcattaacatagtttctctttgtgtcctcctcctcctctttgcctgcttgcctgttccactgggtaagcagcaagtgcctactcaaatcattatttatcaaatgtgtactatgttcccaacattcattcaatacacctatattgaaagccttttatgagaataacaaaaataacaagatagattcagagtaagattcagagactgaagcaagtccgcatatagtaatcacatgttcaactagttgttaagtggtatatataatacatagaaaccaaccgtggaggacctcagggaaaggagccaggaagctgaggaaggctttggagagaagatgacattggagctaggccttcacccaaaattccataggtgttggtccattttgcattgctataaaggaatacctgagactgggtaatttaaggggaaaaggggtttattttggccaggactggtggctcacatctattatcccagaactttgggaggctgaagcgggtggatcacttgaggtcaggagtttgagaccagcctccccaacatggcaagagcctgtctctactaaacatagaaaaattagctgggtgtggtggcacaagcctgtaatcccacttacccaggaggctgagggatgagaattgtttgaacctgggaggcagaggttgcagtgagcggagcttgcaccagggcactccagactgggaaacagagcaagaatttgtcacgaaaaaaaagaaaaaaagaaaaaaagaggtatgtttggctcacagttctgcaggctgtaggtgaagcagagtgctggcatctgcttctggtgagggccttgggaagcttacattcatgctggaaggcaaaggggagccagtgtgtcatatggcaagagagggagcaagagggggggggtgtcaggctccttgtaaacaaccaggtctactgtgaactaaaagagtgagaacttgcttatcaccaaggggatggcgctaagccatccatgagggatctgccctcaagatccaacacctcccattgggccccacctccaacattggggatcacatttcaacatgagatttggaggggacacacatccaaaccatatatcactatgggtcaactatatcactatggatccaggggaggatgggataggggaggggaggcagcaagggcattataggcaaagggaagtgcacatatgaaggtgaagaggacatgagcccacagcatgtctggggactggctggtagcttgatgtgcctggaacaaaggctatgcaatcctgggcagcagcagggggagaggtaaatgtggtcggaatgccaacgattttccatgccagtctgtccagtttgggctttaactgtagagaatggggagccattggtgagttttaagtatgaagtgatgggtttatacttgtattttggacaatcctgtgggcttcagagtactgaatggactaaaagagaggctaaaagctgggagacagttaagagctcactgaaattgccaatgatgtcaaatgctgcaaactcatcaaggaaaatgaagactgagaatgagttcattgcatttgacagttggagatctttggtgacatctaaaagtaatttcactataacgactgaagcagaagctggattactaagccagtagttctcaaagtgtggtccctagatcagcagcactggcatcacttgagaatgttataaatgtaatttatctggctcaacccacacccctttcaaaactttgggaatgaagcctagcaattggcatttttacaagtcttctggatgattctgataaatgctaaagtttgagaacaactagcctaaatgactcttcatctcttccccagacgttccttactctgatgacacctgaattatttgatatttcctaagtaatcattaatatggtttctcagttatctgcataaattgttcctgtcagtcatgtgcaatatatgtacagtctctgcctgataatattgaactcattgttcaaggcctaactcaaatgtcacctccctaggaagtctctccaatttcctccaggcagccccccatggatacttgtgcacatatttatgtcataaaatgtatattatttgttgtgttgatttggtttactatcttccctactaactagaagctcttcgggagtagggactgctttatcgatctctatttccatattgtttttacatcttaagtgctcaataaatgtaagaagaggaagctgtaataaattgcagaaataaaaacagaaagggacaaaccactgttttaagaggtttggaagtgaaagatgaatttgaaatagaaatacaatagaaaatgtgtgtgtgtgtgtgtgtgtgtgtgtgtgtgtgtgtgtgtgtgtgtctggaagaaaactgttggctgagggattaagccagtagagagggaaagatgaatgatgagacagtgggaatcagtgggtattgaatgcaaaatggtcctggagaaggcagaagggaattaaatcaatggccaatgctgaagaattagcattgaaagaaggaaagactctttttttctgagatacaacacaaggaagtaaaggtgggtacataagtgatgagttgtgaggttgagatgggagatggtagggagtccttagatggcctgtcagtgtagaaatggtgagggctagggaaggttttgcaggggaggtgatatttgaactaggagatgtctttagtgaagtaggaagtgaagccttttgctgggaagaaaatggggaacagaaagaaggaaagaggctacagcagagaggtgaagacttgtaaatgctagggaggggattggagaacaacagcaggggattcttttgggctgatccatctccctgattcaagacaaagaaagagtccacttattcatccaattgtgattggcaataaaagaagtatggagggattgtccccaaaggctgtctttgaaataagatggacaacttctggatacagatcccaatactaatatagaaagtattctagctctatatattaattaaggctggaatattttgcagacaataacaatgctatgtatggcaactatgtacaacaaaggaaaatatttatggtatatgaattgcctaagaaatctggataaaaactatatgtatgtcggccaggtatggtggctcacgcctgtaatcccagcactttgggaggccaaggcaggtggatcacctaaggtcaggagttcgagaccagcctggtcaacatggtgaaaccctgtctctagtaaaaatacaaaaattagccaggcatagtcacgtgcgcctgtaatcccagctactagggaggctgaggcaggagagtcacttgaacctgggaggtgggggttgcagtgagccgagatcgcaccactgcactccagcctgggcgacagagcaagactccatcttaaaaaaaacaaaacaaaacaaaactatatgtatgtcttgattacaactctgtaagaacatacatatgaagaacaaatgaataaaacacatgaaaatgctattagtggtggtattataggtcatttttcctttaaattttaaattgatgttttaatgtttataattagttggcaataaatagaattttttttccttgctggctttaaaaaatttactaggaacacttagaagagagtatttcaaaataaaaagttgtaaggtgaaaacaatcagtagaattgtatgaacacctcccatataagggacagatgccaggaaaagaagtccttaagttgagccagagttggaagctgacaagcaagaggttggatgccacgatatagaagagcacaaaagaggtatatgacctagcccttgactcacagtaaacttgagagactaggcttacaataaatgattcgaggataacttattcagttatctaaacaacggatgggactggatcactgaggcagtgacctgtgggcaggcgggacaatgcagaggtcaattatgtgccatcggagttgatcagatggacctgggcttaaatccctgtgccactgcttagcagctgtgtgatctaagacaacttactcaggtttcattttctgcactgtgaagtagaaataataataccttctcataagctgttgaagcattacaaacaataaagcaggtaaaatgcttaatacaatgtttgacacacaaaattgccattatcgttattaacgctttattgttgtgtcatctatgagtatttatgatggaggaaactgatttagactaggggcacattgaattctttggagggacttcagggaggtatcttaagagccgtgagagagtctcaggaggcagtgaagactccctcactgctggaacaatgctgtgggctcaccctaggccttcaggaggggagagagatgtgcaaggaggaactccatggtggttcttcttttgctagtgtttgtgctacttccccacttctaaacaggtgcatagtactccatagcaccctttcatcttcctttcccactcttctgttctgtttttcttctcttcaactcttcttacttcccttttctcctcaaaaccaagtggtggatgggtaaggaactatactatcttttgtgtgttctaactttgccgtttttttttttttgttgttgttgttattgtttgttttaatttttgttttttcttgagacagtgtctcactctgtcacccagactggagtgcagtggtgtgatcacagctcactgtaacctcaacctctggggctcaagtgatcctctcacctcagcctcctgagtagctgggaccacaggcacaagacacatgctaggctaatttttaaatttttcatagagatggtgtctcgctaggttgcccaggctggtctcgaacttttcgcctcttgtctcagcctccaaagtgctgggattacagggtgagccactgcacgtagctcggatataattgttgagtagctgaataggagacctaagtcagccttgaaaatcacctgttcctgcttattttcagggatctctttcctatttgccaataaacacattttagtggactaatcatgaatcgttttatggttggcctcacatttaaaatgttggtggtgctcctcctgccctccaaagccctttatggagcacattaacagagccctgccagcgttacaagctgggccccacctgaggttgtctccattgccccctccacccactttactggccacagaatgtttgtgctttggtgttttcatcagttgagttccttttgctcaccaaagaaacaccacaaaagacacttttgccagaaaacctttctcctcccttgcttcaaatacatcactttacaaagagtgttttaattaaaacagcttataaaagtttatgctttggatttttttcctcccagggaaacagtattcaggctgcatagagtcattctacttggtgggatgactgtcctaaagatgtcctttccctaagcccaatttccccaccagagagaagagcctgccagggttgttagggccgagaagatggtctcagatgcagcagcgtgctgggcccattgcagagtgctcagttcatcttctgggtagtctgtgtctggtttcatgccaggagggagagctaaagggaagctacagaagcatccacggttggcaggactgttggacatttgcggcttcagcagggtcaccctgtttggttgagcaggttgtttctgtacaaggcagcgagcatccagggtctgagtcagggactgagatccagactgtgccaggcttgacctatgcctgccatggggctgggtattagtttcctgtggctactgtgatgaactgtcaccagctgggtgccttaaaacaacacatttcttctctcacagttttggaggccagaagtctgaaatcaaggtgtcatctgggttctggaggctcagagggagaatctgttcttagcttctggcggctaccagaaatctttttttttttttttttttttaatcttaaaggttgtcttctaacttcagcactcagagtttacataagtaagcctgggtttaccctacccactttttcccttatttttaaaatatctatttccccaaccattgtctttagtaagtactctaaaatgacagtcatcagcagaaacgcaaggattccaggccataagagtttgatcaagaaaggattttttgaggtagctatatcttgcaaaagaaacagaggtgtgaactgtctgcagggctcttctcggcaatgaggtgttccttctggattcagatatagatcttaatggggtaaacattctaggtcttaccaccatctgttcttctttttctgcttagactgttagtacctgttataagaggaaaggaggcaaaagtgtgaaagaaaaatggttggatcagtggtctgagaaagaggataaagtagtcatgtgacattattcttaacagagattagaatgattaaaaacaaaaacaagttggtatccaggatattcaggtacaaccaccccttacctgctgattccaatttcacattccattccacattgatgaataataataatgatgtacttttagctttgtcagaaatcctatctgcatatttataaggtcattatgtttagttgttgctgatacctggtctgagtccagcaattaccacctctgtctctttgcacacactggtagacatacacaccactgatttgtactttcctataaaattactcttcccctttttaattagagtgttttcagaagcaaaccctatcgttaaggccatgtatgcttccattataaatacctgtttccagccattaattatctcccaatgaattacttacttagaaggagatttttaatgcattttttttttttttttttttttggagacagggtctcactttgtcacccagactggagtggtggagtggtgtgatcacggcttactgcagtcttgacttctcaggcacaggtgattcttccacctcagactcctgagtggctgggaccataggcgtgcaccaccatgcccagctaatttttgtattttttgtagagttagggtttcaacatgttgcccaggctggtcttgaactcctagcctcaagcgatcctcccgtcttggcctcccaaagtgctgggattacaggtgtgagtcattgtgcctggcctgtgcacactttttataatgggatttctcttccttacttttgatgtcccctctctcatacttagttaaccattttgaattccacttagtaagaaaagtttccattttctttttcttcgggggacttagatatgatctgcacctagatggtaagaagattttccatattttgaagtagaaactttctgtatgcctgaatcttgctgtcaagaatgtcttggctaattatgaaggaagaatataagaatgtgagtaaaaacaattcaacagtccctgagaacaacgtcaataaatattcaaaattgcataaccattttagtgactaaagcactgagactcatccaataatactgtggtttgataattacacagttgtgaatttatgatactgttaaattggggagacatcttggtgcatacaggtcaaccttttcatacatcattatatacaaaaagtacacacctacttaggaattgaagtgtaatacctcctagcataaaatgcttaaaagaagattttaagggagtgatacagtgagcattcctatatgaattttcctgcttatctcaagcatagcagaagatgtgaaatttctaggtaagtttttttttttttttttgacagggtcttgctctgtcacccgagctgaaatgcagcagtggtaacatggttcactgcagcctcaacctcctgggatcaagtggtcctcccacctcagcctcccgagtagctgggactagagacatgcatcaccatgcccagttagttttttaattttttgtagagacagggtctcactttgtggcccagcctggtcttgaactcctgggctcaagccatccttctgccttggactcccaaagtgttgggattacaggtgtgggccactgtgtccttccttaacataataaaattgagataatcacattcataaaagggcaaaactatgtcaacaagcccactgtattagtctgtcttcacagtgctgtaaagaactgcccaagactgggtaatttataaaggaaacaggttaactgactcacagtttagcatggctgggaaggcctcaggaaatttaacaatcatggcagaaggcaaaggggaagcaaggtaccttcttcataaggcagcatgaaggaaaattaatgcaggaggaactaccaaacacataaaaccatcagatctcgtgaactcgctcattatcaggagaacagcatgggagaaaccgcccccatgattcaattacctccacctggtctctcccttgacacatggggattacaattcaaaataagatattgggtggggacacaggcaaactatatcgcccatattacaattacttacattactgattcccttaattagagcagaggtaattaattgggtctaggctcagtggaagggtctggctggttcttaattctcagagctagtttgaatcttgaggttaacgtcttgccttctagaacttgtcctgtgtttggctgaactctgtgaacctttcagaaagtaggtctttattgagcacatactctatgcaaggcaaagaaccaactactgtggagtttacaaacatgaataaggggtaagaaatgactcttgtcacatggtttacagtccagctgtgtgggccaccacagttcatatctttcaggctggggactggatgagaggaaagtggactcaaaattaatcccagtgctctctactttcccatatccctgtgctttatctctgttgtagttatgttatttgtatgttggcctgcctcactgctctgtgatctccaaagaacagggactaggttttatttatttctgcattgccgcagagcctagtatgtgctttatagagaacaggctctcaaaaaaattttaaattaaaagaatgtattcacttgtttatgtttcctagttacagtgggccagcttgttctgtgctaatatggaagtgacaagaaactggtgtccctctacgcagaggtccccacactaaatatcatcttggatgtgcttcacattgttgcacaaaggtacagtggagtgagactgagtaagaggacagaaatagtggggggtttgtctcagctcactaattacttatttaaccttgggcaagatacttaaagctctatctcagtttcttcatctgcaaaatggggataataatgactggggtgcctatttcccacgattgttttgaggatcaaatgagataatataattaaaagtgtttttggaaggtctaaatcactgtgcaactgcaaggcattattaaaagaaatcttccttttaattcctgcttccacaaacatctcatcacatatccttgggtccctgggttacatggagagattcgtggtgtagctcaatctatgtgtcatagctatcccacaatctcttcttcaacttctccaacacaccaagacattcttccagtcttgcactgctccccagtttatatagatatatatgttcctcattcagcatttatgtaaaacatatattattgagcacttatgtgatagaaaccggggcaaaacagaaaataaaacagagttttattttgagagttttttacagcttgtcggctctgagaggacagacatgagaacaaataagtgcccaattctgcatttattttggaaggcagttttatgtgagtttaaatcagtaaagacatagatgtatatttttagttttgattaaaactaaaacaattggtagcccttactcatatttttctatcattaaaacttatctttaaaaaatgtcttcagtcatatttttcccttacttccattcatatttactctttacttctcttgtccttaccagaatgtatgcagtaagttttcatattgtaacacattcaacaaaagttatatgtgaacataatagctgctttctttaaaacggttactttgagaaactgcatacctatttttttttttttttttttgagacggagtttcactcttgttgtccaggctggagtacagtggcacgatcttggctcactgcaatctctgcctcctgggttcaagtgattctactgcctcagtctcctgagtagctgggattacaggtgctcgccaccatgcccggctaatttttggtatttttagtagagacgggttttcaacatgttggccaggctggtctcgaactcctgacctcaggtgatctgcccacctcagcttcccaaagtgctgggattatgacataagccgccacgcctggcctgcacatttattttaataatgttgtcatagctacagtcgcttctagagttgctctttggggataactatcttatattcttctgaatatattttaatagtgacaaaacttatctttgcaggtgatttttaaaatttgtatgcagccaagtcactatgaattatctttagtgagtaaagaggaagatcgaactggtaacactgtgggtaaacaactgaaaaataatgttatctttctctgaacatacttgcacaagacaaattccaaaaatattttgactacgttatttttgaaaagggtttccagtatttcaatgtgactactttcactaatgatacttgcttacctaaagtgcttgttaacatgcagttttggaacttcataggtctatgcccatactgacttgtacttgcttagtgttgttttacattctagttcaacatctattatgtgatagacactggggattaataggctgtggtctttgcccatgaggacctcaaaacttagttgagaacacagaaatacaaagagtcctgtgtgaaaaataagtatcggtgttaagataaagaagcggcagtggaagacagtggagggactgtctgttagagggaggaatttattgtggtgtcggcaaagccttctttggactgaaggatgaattatgattagaagttcattaagaggaggagggaaggggactacaggagtcattccaagccaaaggaacaaaagatacagggacagaaacagcaagatatgtttgggggaatctcaagtaatactgttattgtgtgaagttcacaacaggggcagggaggacaggagatggggcccaatgacgaaaaggccttgtatgtaccatgtttagaagtttgaattttatcctataggagtcagggagaggttctatgggtaggatttctcatcccaacaggattgtaaactcccacatccaattagtcacacctccattttttttttctgtttctttaacattgtctcagattcattccttctgaaatctaccttattagttcaggtcttcttaaatttgtgcctggactgttcaccaactcttgactggtcctggggctccagttcacctcttgctcccaacaatcaattttctacagaattatcagagcaatcttcctttccatcaatctcaactctgttcaaaaactttcaatagttttatgtgacctaagaggtagctgcctccccaccctttcagcttgccattcaaggctgcataatttggtcccaaccccctttccgtccttgactcctctcactgctaacagagacagaactcatttacttactcttctgactgtacctttgctttcacgagggctctttcctggaatgatatgtccatacaactattgttgttgttcttacttttagctcttttcttagcccacttgtacccaggtttgatcacaccccctactctcctgccctggaagtaactactattctggttatagtctcttaatatctatatctatatatatgcatccacagataatgtgtagtattgtcttgaaaaaaatatacataaatggtatactttgtctccctctgcgattattttcactgtcatttagtttttaagatttatccctattgacataaatagctatagtcttttcaattactgtgttgcatttcattttataaatataccatacattattcatccattcctctaagggtgggcatttatgttgttttcaaggttttgctattacagtgttacaacgaatatccttagcttagctggtctccttgtcttatacaaattttactgacctttcaagatcctgctttcatcccagctcctctgggaaagccttccctgaatcccccagcccacagcggcaaagtcttggtactcaaagttgcttgtgcatctttggtatcatcccactgccaagcacacagctacgcaaagtaaggcacttaagaaatattcgctacacggatgaacaaatgaatgaatgaatggggcagcaccactccgtgatggctctattcctttttaatggactttggcgccttggcccactttccttctttgacagcactggtcctactccagagcattcctctagctagcaaagcagtgtgtggatgtgtgggtgtaggtggcgatacagacctcactggatgaggaccgcctctccctgcaagttcacgatcccggcaaactccagtgcttgaagttcagagtcctaccccacccccctcacccccacgccccttctgcactggtcaagccagcgagccgctgcagccctgatcgagttaaggcgcggcggcccccggggccgctggagaaggatgcggacggggccagtgactcgtagtagatccctccgcgcggagctcgggccggcgcttcttcctgcgggaaacccctgggtgcccaaggcggcggggccgaggccgcggcgacagtggggcggggcttgcggtgggaggaggcggctgaggcggaaggacacacgaggctgcttcgctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggcggcggcggcggcggcggaggaggcgaccgagaagatacccgccctgcgccccgctctgctgtgggcgctgctggcgctctggctgtgctgcgcgacccccgcgcatggtgagtatcgggctgaggggcgctgtccgcggcgcccggggctgccacctggggcgacccttctccccctcggtccttctctgtgtgggaaggccaggctcggccgccggcgcggagcgaggccactcgctgggttcccgagagtttggacatcgccgggggcccctcccgtggtgccccgccaaccgccggggttccccgccaaccgccggggttccccgccaaccgccggggttccccgccgcctctgctccccgcggcccgggacccctcacacgcctcctcggcaggagggaggccggcagcaagtctcagaaactcctttttcgtagtgccagggtgcagggaggtgggcagttttgcccttcaggttccgcgtttcctggggtcgagcgagagccgacggcgggcctcggaggggctgagcgaaggaatgccagattctggcgtggagagcgggggcagggccgccaagccaaacggcctgcaccttcgcagccagcctcgcctttgccagggggcggcacatgggccgggtgtgtgggcttggtttggatggggacggggttttgcggcgcgcctgagttttgacactccaaccccaccgaaagtccggaggagccgggtgtgctgctcgcgtctttgaaaggtggaggcaggagaagtagggcaactggtgtggctgcatgctgaggcacatgatttaaaaatctcaactgctgttattctttctgaggcgcggagctctgctgctgtttcaggctgtgtccagacccaggaatgtggtgtgacgatcaccaattcctccaacctggcagcagcatttgctgctcctttggcatggctgggggtggggcacgggcgggtgagaaaaagtggatacgtcaattcaaagggcttccttagaaagcttctttgtggttggatgtttctaacacggttggaccaaggaaagggaatcaaatcatatcttccccatcccacccacacttttagattctacatttcttcagaccctttagtggaaataacttgggctttggagccctgctctgtaatcctggattcaaatccagctctgctatatgaactcaccaataaaatgggaatgaaattatccagctaataggattaattaaaataatgtatattaaacggatgacactccaaaggtgttcagaaagtcctttgagggccgaggctgtgttttactgcttctgagattgatgctcccagtgggatggtgtcttgtgcatatttgttgaacggaaagcagccccttctttttctgagcctaatctgaataaagatttttaccttcaccaaaaaactagtacatgaactacatctgttttcaaagaaaaggttaggaagatgatgagcttcagaaaaatatggtctttgttcattgttaacagtcagtcgacatgtcaatcgcagatgtttaaaaagagaacaaggttatttatcacccgaaaatagtactgggttgttcagcaccaactagatacttcttggaaagttcaaatttcgtacacgtctaggtcactaagaatttcagaagtggaccaggaggctttgtagtgatgaagcagagctgttgtttctgaagcatttaataaagagcatatatgatggtgtttttgcttttcctttttctttgagtgaaagctttaagtgtagctttaggatagagaggagtataatcaatgagacagtctgagggtaataatccttggtctatcattaacttgttttggtaaataacttaatcttcatgatatgtagtctcctcacctatgaagcaggactaaaggaataacctgctttagagaattgtagggaataataaatatgattgtaaagtgatttgaaaaattaagtattaaataatatgtcagaaatgggattactctgacacatagggcttcttttattataggatctcagtgcgtaaaactatgccctccacctctgctctgctgaggtgctgcgattattagctagcttttaggtagtcaagttgagtgttagtcaagttgactcaaaggataggatttagatattttgatttttagacaggtgttctttagatgctaaactaatgcagtagaagagatttagaagcctgtttcttggtacaaatcttaaatcttcttagagtctacagtgaaggcttcttgaatcctcctaatttattattgtgttttgctaaggtaccaattacagcacacccttctaaacttttgagtgttcctgtgtttggcttgtggccaattgttaatttaaacatcacggagtttctaaggcaaggagatgttagcagtatgtctgattgtctaaacagctatccaggaccatactcttgctccttgttttcttttgctttgcaatgggaagtgactccctgattttgctgcctgctagataatttctcagctgaattcttctcttgcttaaacaaaatcggagtaattttctttcagatggtgatgaaatttaacctaaaactatttttcctttcactttcttattattcctttttttttggtgtggtggagaggaggaggagagtgattcctagtctctcttatttttctgaatgtttagatttaaaaaatatttacccataacttcttgggatctctctgctccattcccaccctactgcctctcctgtaggcttctatgacatagagaagcaacttttggttcacctggattgtagttgctgacttcaggacctttagagaatgtttaaattcagtgggatatgcttggatggttcagagcagccttacaatacattttaaaaatatcacacccacagaaattctattttgcccacaaaatttgcattgatctagttcccactctgtgttgccattcctagtgatcctcctccctacctctcccattatggtagaaaaaaactctgtgtcctggctacatcaaaatctgttggggtggatcttggactcagcacccagggattctgataaggtaagtttgagaatccatattttttcaaggtttacaggtgattctgacaagtaacttggttgcaacccactgattaagtacattttttttttaccttcaggtgtgtgtatgaggtctttctaaatttaagaaatttccataacaaatgtaaccttagtcattccagtgtttaacacttctgactcaagaattttaaaattgctaacgtaagagatatagaatataatgtcatttcttctgtttatctgggtgcagtatgtctgcattgaccctttagaagggcttcatatatttagatgatataataaattctctacctctccttttcccttttcttctgttatctctttttccttaaatgtcattcatacatgttgttttttgaccctttatctatatacgtctgcaatgattttagagtaaaaaactgcaaggcgtgatttgaataaggatataagaaattttacatcattttctttatattgtgttcacagtccatagttacatgcttcctttcttgatgtctcagttcgaatgcctaaatttgaactattaattttccttccaccctttcctgattttcctgtttttgtttccccccctttctctgcaaatgacttgaaaccaaaaggtcttcttttctttctttgtcagtctaccatatgtgtagtattttggacagatcactgaactaggagccagaagaccagaattcttctccaggtctgttattaattggtttggtgaccttgtaggagagccactgttttggtcctccattttctgatgttcattgttcatggtcacagagccaattagagttgagactagaattcctttcttctggtgtccagtgcctcattcactgtccacattgcttccatctcgtgtacaaatgcgcttatgtgcacaaaaactcttataacatcctcaagtgcttattgttaatgcgtacatgaggaaggaatcgtgtattttcatttatgtgtttattctaatgcccataccctacccctgtacctggcatgatgccttggtatctaataggcacacaataaatacttgttcagtcgaacaattatttttagccactttcttattttggacaactgtggtactcctagacattttaaaaatagtatttgcaggagtcatgcttaccttacatttggggaaaaaccaaatttttcccttccccagatgtttcatttaaacttgtaattttgaatttctttgtgtgtggggtttctttctttctttttctgatcacttctgcaatttataaaggtcactttgactttggaatctcacttcaaaggcactgccatccaccccctgcctctcattcaagtttgcttccactgcttcctgtattactgtattactaggccagcaatttctgttattttgtccagaatagccacaccttattgtaatttcatcattttggggactagtcatttttggaatactatttttaaaattagagttaactaagtttatatttattttgataattttttttgagatttttttcattgagttggatattgcaaacttgtactggattgagagaatatgtacatttagtaaagtatatttgctttttttttttttgaaccaagagagtcccctgaacaccctactgacaaaaactaagggtgaaatatgatgaataaatatttgagagaatcacatggtgttgagttgtctctgccacatgattttgatccttgagggccaggtctgtgctacacacatttcttctctgtactacagaacttgtctggcatgtgccccaaattcagagtcaactgagcggcaggtcttagtcacagcatctgtgactcctgctttcccacctttagaacattctataggagaggctgatggtgagttggagtgtgtttctatgttcttttttcctttgaagagataggatcagttgaaagctgaccccacccacagactttttttgctatctcttttaattaattaaggagtggctgaaattttcctctttgttgacttatgcattggtgggaactttaaaattcatctagtctttctgtccatcccatgctggatctgatgtttacaacattctagtcaagaggtaccatattttctctcttcttgaacatctcttgtggtagacagctctccacagcagtttattccatctttggccagctctaattcttagaaagatcttcttatattcagctgtaatccatctcctcatgacttgtcctcattgacatctactcagaaatttgtctcagagtcctgagacctgtgcaggtgatagggacccaaagagatgcttgtctgtagactttactgagctgacacccagctctccataaaaggagtcaaacccagtgaggagcatgtctggggtgattgctcaggtaaagcatcttagccctacttgtttcatacctccctgcacaggtgggcactggtgggagaataacatttatcaagcagtgtttccctaacctctcttatgataagaatagctcaggtgttctcatggagattctgattcagtgcatctggaatgtcatctgggaatttgtgtgttcaagaaatagccaggtgattcttacattaggaaagttttagaatcactgcagagtgaatctgggaaatcaaagtgtttgtttttgtttgtttgttttttgagagtattagagacaggttgctttggctagatcctgtggtcatttttcccccttggaaatgcctcctacttgctggcctcacttagtacagagaagaaagctgctatggtataaggttagtaaagttgtttgttttgtcttaaaagaaatttgcgaaatccagcattttcggacttctgtttgtgttgtatgactttgttgtaagcctccttattcctccattagaatgttacctgagatgttagaatgcataggagttccacagcctttttggtgtccactaaagaattctgtcctcagccgttgcaaatggtgcttcctttgaggatttctgcttcgttagctcatgaacacatatttggtgtcggcagtttccctcagatgtgttagtgtggagagatataaaggtcactcatttctggtggtcctgcttttggggtttctgggctgctgcagcaaatgaaataaggaaaggaaaataaaggaggaatctagggcttcttgagcagaacaaaacaatctgcaagaaggggcacaggattgctcctctcacaaagacacttgataatactgtccttgataggaagaaggaagtggcttcagatctgaaaggatatgctcataggcttgagacgggacaaactgcatcactggtagtggtaggaggtttgccgtagatctgttttttctcctgtctctcttttttgaggagaatattatctgtatggcagaacatacattgtggtcttaaaaaggagagtaaagccaagaaagggggatgataaagccatagcttggaataagaaaagcaaaggaattattgtattaatttgtgtatgtaaatacataggtttccatgtaattcactggtaggatcactagcccttggcactaacatttgctatctttgtagctctgctgtcttagtggtgtattgggggagcattgtggtgtgttgtcacacttaatttgtgtgcttcccttggcatcatgtggtagcaagtacagggtattctactcttctagatgtgtgggaatcattgaccaagtagaaaatatggtcctgctcccaaggagctgacatcatcatggagacaagacagataagcacacaattaggaatatgaaatacagttattttatcatttatctatgctctctgaaagcagtttcctgcagtcagggtgactcagagctatagggtcttgggagtaaacttcaggtcttaataccaccagggaaaggcgacctccagctcacccttgctgggcttgtctgctgtcgtgagctgtctgccattttcctctttctgtgttgtaatttagaagtattagaacttggcttggggaaaagacaaaaacccctttgtctggtgagggtgtaaatataaatttggcacatgttgtggtgtctattatgtctgttagtgggtttgcggcaagagagagtgctgtgttcttagtcccgaatgccaagcctgaactaggacaagttatggtggaaatatcttccttggaagatgcagttctcagtggcagtggctgaaggaacttctcgtcacagccaggcagtgactgaagtgtggtgtggacacacccagagttgctgcctcaggtggcattgattaatcatactaatatctccctcacccttttgtacttgtcttggcaaaaccctgttctactagctccccaatagtttggcctttactaggtatgattgaacaagctcttgggggttcaccttagtgtcccttgcccctctcgcatttccagccagctacgtcgctccagccatggtaccccgggtcctctggccaggcagtgaggggctgggtttttcttcccattggactgaagcacctttccctggaggcttgcctagggcagtttctggtctctgagtcagttccttctgcaggatactggcagctggcagaactctgggttatttgaatacatcagccaaacatcttgccaagatggactcattgttgcataacgacaggttggatctatgggtgttgcagaacctgtttctgggttaagagtaactctctcacctttattatatatgtttattcatatgatgaatgtatgtgtgtattttgtgaagtaaggaaaacatgatgataatattgtggttggagttagataccttatcctaaatatgttgtctttttaacaaatagcattcctttaaaatacagttgtgcttgatgaataaggtgttgtacaagaagctgtggttacattctaaaataaactgccttgttctgaggcaggcacgttttaaaattgttgtttgcttctttttcatctctttttattttcatctttttttgtgtgagaagattctggaagtttttaagcctcaaatattttcaataatctattttaacgggtacctagcagggagaggttgttctattggtatacctaaccaacattcaaataagaataattgaatactgtttactcactaatctattctgttgagtttctaagtatgaataatcacaaaactagatagtgctgatatattaacttctctaaatggtaaatgtggtaagtagcaaagacatttttgtttaattctctccttacacatgctttggttcagacgctgtcaagacacattgaagtttgaggacatgtgtatttcgattattttattatatttttatttgctgtgaatatgggtttatttatttgctagatcttctttagttagaaacattaagggcatttactttattacaacatttaaagtgcattctaatcttcatgaggaattttaggtaaaagaccgtatcctgagattcatgcaagtctttggcattatgttactatttaaagtaagtaatatgtagtggcttctctgacatattctttctaagagagttaaggaaaatagttgtaactaaaagcaaacattgaaacagtttaaggtaggtttacgtagcaacagaattattcgttatgtttacagataattaactcatatttatactttgctgattttctctggcacctttacaagatttttttatttttgtaatataaaaagtaattatgtttgaaaaagtagttaaggatgtttgaagaatctagaaaagcataaataaaatgtccacaatcatgctgccattaattttttggtatacgtctttggtttttttacccttagatttagaaaagctgttgatttatttatatatatatatatatatatattttttttttagtttatgaacagatctacatatatatatatgcacacacacataatatactattgtcaacactaggttttatttttaaaaatctttaccatttgataagtggtaaatattacttaatcttaatatgcctctctcattacagtgatattgaatgttttttcatatcatcagtggcgtttgtattgccttttttcctacttcttttgtaaattgtgtcttttactcatttaattattttcttactggtttgaaaaagctctttaaatattaagggtgttagtcttttgtcttaaatatgtcacaatatgtatggaaataattagcagtatataacataacatcaaattgctaccaatgttgatataaaaattgttcatttcataggttaattttttttaatcctttggtttctaatgatattggttaattcatttgttaactgctattttctgtagctacttgaaagttcttatctgactgtatcgtaaatcagcatgctttcagctgtatatgtctaggaaattgacatttactttaatacttaataaaaaaatatgttggagaaaagcagtgtattctggagtcaaatacatgattttgggtgggtgacgtaatcggctactgtcctccttttctagatagccaagatttttgaagcatttaacatccctgaaaggcaggactaatgctatgtctaccatgcactgctaattctgacactttgacctaatggataaatgccagtacagtgggtctagccagttagcttggtcagagaacaagatgactaagattctctccccctttcctcaccaaattgattagttgtaggacagaactgactgaagcaacctgttgttttggcaacccatggacaccacctgtttcttccattcctccgtccagcctctcactgccctagtgcagtgctgtgtgcatagtgggtaggagatcaatgttgttgctaaagaaagtagcaataaagaagagtagattgctttttttccaagcttttgtgtttttaaggcaccccgctggttttgacattcgttgctccagctgaactgctctatgctgaagccctgcaggtctcaagtgtttggttcagagtaatttcaggccatatgaatgctttcttaagtatcattggaatttactgggctggctgtctgccagctattaccatatttagcatgaagagacctggggaatgaggacatttctgatcaaccaaggaaggaaacctatttgaaggattacaatattttctttttttttttttaatggtgtagttcagaaaacgccagttagactgagactcagatttatgtccactggtctttgtttctgtgccccatcccaaaattaatttatgaataggaaaagagatttgatagtgaagttctttctcactctgaagtctaatactgtttctgggaggaagtaagagaattattatgcccacactgtgcactgagaggcttaaccagcaggtgaagctgttgattaaaaacataggttgatgagtattctcatttttctcctttgaagctttcagaaattttctgctttgtcctggtctaaatttattttggcccagcccttgtctccaccctacatttcaaaccagtagccttccctctatggctcaacatttctctgcctcagttttttccattttaaagatgaagatattgtttggaaggaccagtaaatacaattaatataaaaattgcttctgtagaatcaaacaacctccaacatttctgttggaaatttatagtttatagagtattcttacacaatgatctcctttaatcctcacaaacttggtggaaatggagcctcacaggggctaggtgacttgtatacattgtttacccctacataataagtgacagagctggtacttaaacttgtggcttgatttttctttttttttttgagttggagttttgctcttgttgcccaggctggagtgcaatggcgcaatctcggctcaccgcaacctccacctcccgggttcaagtgattctcctgcctcagcctcccgagtagctggaattacaggcatgcaccacaacgcctggctaattttttgtagttttagtagagacggggtttctctatgttgggcaggctggtctcgtactcctgacctcaggtgatccgcccgcctcagcctcccaaagtgctgggattacaggtgagccaccgtgcctggtccttgcagcttgattttttaaacatcagatttttttttcttttttgatttttattattatgtgtctgtcattctgctaggggctttgcaaatattgctttatttaattcatatggctatcctttggagtagacaatatttttctacattataggtaaggaatttggaacttaggttcacagctttggatgttggcctatggttagtgaggggtgtagccagcattcaaacccctgtctggctctagggccgctgcaataaatcatggtgttttatgtacattcatacacttaacactttgcaacaaccctaagagacaggggtaggtatttagggaaactggggcttctaacttgcacaggataatgcaattagtaagtggcttagtcgagattcagagctagatctgtctccataaccctcactcattccaggatactgcagatgcctatttttatgatatgtataagtaaaaattaatttaaaaaactaccttctttgaagggtcagccagttagaactcttttgtatcttctgaataagtaagaagtggatggacattagctgaccgatacattgatggcttttaaccttctatcagttgatttccattaccaggacaagcaaatataatttggagggaaaagaggggagtttccattaaggatgaatctttaagccgaaaagggccacagtgatgaactcttcagaggactgctctcaggagcaatggcccttctcctctgggctctgcttggggcattcctgtttgtatttatggagacatctttttgaaaggcagatgccagctttggtggggagaaggttggaaaacatacaagccttgctctaaatttactagccccgtgtctttgggctagtttctgaagcatggtgtgcctcaattttattattttaaaaataaagatagtagcagtatattttggagttgttatgaagataatatcagttaataaatgttagattcattggacagtaccaggcacatagttaaagtgcagtaaatagtagttattgttggtattggtgttattttatgttgcagtacagactggcttcttggtgcattcacttttctttaatcaaaagtggatgagtgattgggaaccttcatgaggaaataggaacatcatctttgcagcctgtggattgttcactggtttcctgtgatctaataattatttaagggtttcatatttgagtcttttcccttaatgaggtacactttcagtttggggagattttatctataggcataccttattttattttgtgttcccttttattgtgcttcacagattttgttttattttttacaaattgaaagtttgtggcaaccctatgtcgagcaaatgtatcagcaccattttttccaatagcatatactcactatatgtccctgtgtcagtattttttagcaataaagtatttttaaactcaggtatatgcattatgctttagacataatgctgttgcatgcttaatggactagagtatactgtaaacataacttttgtatgcactggggaaccaaaaaatttctgacttgcttcattgtactgtttgctttattgaggtgagctggagctgaagccacaatatcacaaaggtatgcttgtattatgcaagttgcattgataggtgttaaatcattttcccaatttttattaaccacacatttgtgattggatgttatgtttagtaaagatattgtgattttctgaggtacagctttgagaacagtatcaggtctaacactcttgtttccaaatttcctatgatatgacaaacataatcacatgccatccagtgtcaccatgcagagtactaatgtgaagccaaaatacttggtgttttaattagccttaaagcagttaatgaactatctctgttagacattttgaaataataaaaatatcccattgtcttttattacaacctcaggggctcctggagattttgggatcttgtgtggggaaccacccatctaatccatccttgttttaaagagagaaaaccaaagaagcaaagtgactggcccaagtacctagagctgggtcagggttggggccagaatccaatctcttgacttttagtcaagtgatttttccactatgctcagtactcaaattatgtatcaatatgtcggcccttgttttttgaggtctgaaaagggttagtgccagtcaacaacagtagaggagtagaaagggtgttgggatgggagaggtgtggctatatttaaaatttcaatgacagcagtgaaaataatttgcctgtgaacctctgcctgtccctttggacttctttgtagtagttgagacagcccggcaggtctggtgtcattagtgattcagaattggattaacctggactggtggagttactttctcagaaaagggctttatattttaacatttgtttcccttgacagtttgcttcttctcaagttttggcagccttgaacaagtggttgtcaggtttttattttgttttgttttaagaaaaaattccaaattttattttgccgatttagtaagttatcctctacctgccactcccttctgctccctctataattatttctaagactttatttttccattgtgggaacattatggaaggttttcttttacagtctgagatatttataattatgtgtaagcacacagtttatagaatatgtaaatggtccatatgttaacttaaatacccttaaaatattttccaataatttaaatctttccataaaagtagctgaagctgcttataataaaagagaagtatacacgaaggatagcagaatttggatgtagttaatatagataaatatgaatgtcactttggaggaactggaagtatttgcatgaatactgatcaagtcatgcctccttgttaatagagtgaacaaaacagatgaatgtttctgttttcatgaagtttatgtgactatcagtagcttccatattctgagggtttattatgtgacagatgcttggggacaaaatactttacttgtttcctttagtccttaaaatagatgttaggattcttgtttacagaaaagttaaggaatgttcatccagatcacctagccagtcagtggtaaagaacagtcactggaacccctctttcctgatccaaagccaacatacttaaccataataaataatgccattgtctggtggaatcctgtagtcccttagatagtgtaattttgtatttaatgtaaacattttgtgcactaaactgacttacattttactttttaaaacaatattttaattctgaatgaacatttgcataataggagaatgatctaaattgcaaacttccattttgaagagttgtagttcttttaaatctttttgtaactgggaagaagaatggaattatgtttgttgtaatccaaggaaagttggttagcattctttcctgttactttttgatcccaaaagaaattctttagtagattaagaccaggaatgaatgtgtggatttttttaaataaaaaattgagagagattgcaactagcaattcagagccagatttatgttcagaaatgtttgatgccagccgttttagttacaaatagctttttcttgactgtacagttgtgttcttatggtaccattctgaaagtgatgtaagagaccatgtaaaatgattggaatgcctcagcatctgaacaatgcacatagccaattattaaaattacccagtactaacctgtcttggcttaggaactatgaaattaactgtgggtagcatttctacacatatcattacagaacaagcataaagacaagcttgtttttttccttttctttggatttgttttttcttattaccatatcttttgttactgaaaactggtggtcatctgtactaatagataagagaagtgtgtttgacaccaatacctaatcttagattatccctgctattttaaaacacagtccttcgcctgcatgctcagacatgtgggttctttcaaacatactggacttcctccttaggttttagttgtgttagtcaatagttgaatgttgaaggagaggatgccaagggatattaaagaaggtaaaagagataagtgacagcaaacattatttatttttaattatctctcagaatgacttttagatacccttccctactaccttttgatttttgctttagcatagctggtgagttttggaatcagagagactgggctctgatttgtactagctaagaatattagacaagccacttaacttctttaagtctcagtacccgtatttatataatgggaataatagtaatatctaacttgcaggattgtttgtaaagattgaaagcaacatatttaattgtgcttgcgtggttctgggcacagaataggcacccgagtgtaggggcccctgaactttaaagttcattactttcatggtaattcctcctttggaatatatagcctgggaacatttgtctctagaccttgtttcagtttcttttaatgactccctttaggctctgcttcatggccaatgcaagattatggatcacctaaagagtagactaaaagtactattgtctagtaacttcaagtttgtaggttaactcactgtgaatcaaaagcttttaaaaatcttttgtgtggtcatagtttgtagtgtcttgtacctctcatctcagaagcaattgattcatagaaaaaattatttaggatttcagattaaagatgaagaactctttcaataagaaggaactgatttggttggattatttgtttctttcacccctgagttttcatggaaatcaggtttaaaaggttagaagcagttggttttcagcattgggaaagcttatctgatcaggcatgcgaagtggcctatgtcggatttctgagctaggaaaggctaggggaggttgaggagattattgtacttgtaattcctgagcatggttgagacacaaggagaggattgtggaaattgtttttaaaaaattgttgaagttaatgcattcttgggtggatttgcaaaacagaacaaaacaaaaagttgttgaagttagttacactggtctaacaacgtatacttaccacccccatttgggctggaggaatggatctaataataatataggtgtttgtgatctaatttgaatcatgtaatcatttatcatttctgggttagatggtaaggattttctgtttcacagatttttagactgggaattgtgctattataaaataatattttacattaaataatgctatctaggttgtaatcaccttaatagacatgatttatttgggccacaaatgaactctggtaagaatggagggctggttacattattttagttttacagatgaaaataatcagtctcaaatagcttaagggaattcctttagaccatatggttagtatatggaaaagccagagctagaacccaggttctgatttccagagcagttcttatttcatgataccgcataattttataatgtccctaaatccgaatttcatttctcatgatgtgaaaggattctctttatttctgtttggttagctgcatcagagcatgacagaaatggagcagaatttgagtattctttccccagatgggtcagttagcttttcttaaagctattctgtgcttacattgttaatcagttgtccctggttcctagacaggatgttgatacatgtgaaataggcaggaatatgtgtctgactcagcttaactcatcacaactttcatatgtcctgctagtgggtctataacgtcaccctcgtttacaggcgtttttaattttctgatgtctatttcttagtatttttcctcagccatttttaatgtctcaagccatagttcttcctgagtggcctgaagtgattttgctgctctttaaagcttccttaaggtttttcaagagcgtacaacataggctgcttctaagtgtatttttatttcctagctcttagcatttctcaccttatcattataactttaaatttaaacagaatacaaattgtgtacacagatggtgtgtcactattgcactgtcacttatgtaagtgcagtttagcatttcttctttccttttaatcaaaatgaggaaatagaaaatgttttgttatggtagttttacacatacacccacaaggaaatgtgtatctagagtctgtgggaactgtgactgatacatttcagggaataaaatgtatgatggctaaaattttaactctgccaaatgttcacggggaaagaaaaattaacaaactcacattttacactttattttagcctagtctctgccttgtttacatctatatgataatgaagctatacttgtctttccacaacagtgtattttataagttgtaccttttgtttaagggagccttcttaacaaactttctttcagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttgacacttttatgttgtgagagctgagattcaccattctccaccatcctgagaagagctttgatagaagggctactcgtgaggtacatagattatctaaaatacatacaattttttcatagaaaattatatatgtattataatttttattcacgacaggttgaaattaatagatttcttacattcactgcattaaaggaatatttatggctttggtaatattttaaatttcaaattaaaaaatttgaatatctgaattaagtatctctgatttaactctgtgtgtgtgtgcgtgtgtgtgtgtgtgtgtgtgttgggaggaggaatagaccttggaattgttttttcaaaactttttttataatagtgcctaatctcagttggcaaggaatagctgtccagaatgctgcatagatctagtgaaaagatttagggaagttgtaactagtttaataaccatctgtggagtgacatagattgacacacccaattacacaagacctgagtctgagaactgttgatgtgcaatcatcccatcagcatctgctcgtcattatcaacaacaataatggctcaactatttctttgaggccacatgaaaagacagtgtacccatagcaaaggataagtcagacctgaaaaaaacatagccctctgcatccccttgttcccaaacttctttttaaacataaccttttgtgaagttctgaaagaattcattttatgttttctttttattaatttttcttcttaaataccatgtctttctggctgaaatccttgccaaaaccaggaagggccagtgtactgtgggtgatttttctaattcatttctttgtcatttgaagccttctgtggcttcatgctgctttatgtgtgtgtaaatattcagtatcttttctagtttacacttttgtcacaactgctattaagccacctatggacacattctaatataaattattttggccactgtgagtgggagggaaagaatcagttcacagggataaatttgcatgttgagaagataatatataatagtttgcaaaacacttctatgtacattgtatcttttatagagacaaggccatgtttttatttgtggagactgagacagagaccccatgagatctaatgcagagtcacatgactccaaagccaggtcttctatctgctctttggtatataactggatcattattctattgacagaaataaggaatcttcttatttttcaaaggcacccttttgcccttggaaggtatatttagaaatcctttaccagactagaaagaagacagttatattttcctgccttttgataaaaaacagtgtgttttttctaaatcttgttgtgtttgactagagtctgattaaggtaccttttgggaaattaaggttctatagaaattactgggctcaatctagtgatacaaatatgtgttgtttgatttatcaacacattacaaaccttaactttggagttttaatatctggttatctttaatatctggttatcttctttctgaagtgtatgtacacaaaattgatgctaaataaggtcttgttgttttggcaaatagtgaaatgcaaggtattggtagatcagtactgttataactttggtgcaaagttgctgcatgcagattggctgtgggaccttgttcattttttgagaactaatgtagagtttgaaaaaacaccgtaagcctgcattccagaagttctggtatggatagtgtgagcccagggaatgtgcttagataaaagatcatttaacaaataggttttgcatttttttagcaatcaggctttgtgctgaatattagagtggttgtttcagagagtttgcagcaattaggctttattggtgcactaaggagaagcagagaggagaagcaattcttggtaacttccttggaagttgcagctaactctgaaaagtctgggttgaactaggtaagtaactaattcctagaatcaataaactttgcaggagtccgtttgattgtacatgtagctccctggaattgctattggtccctaaatcatcagtttgtaatgctggttttcaaacttgagtgcacatcaagttttggaggacttgttagaatacagattgctgggctcacccccagagtttctgatctggtaggtctggagcgggacctggtagattgcatttctaaaaagcatccaggtaatactgctgctgtttgggaaagtacactttgagagtcactggcttacagcaatctcaaggtgtttggatttttgggcaggggtgctgtgcaggcgttgctgggatctcttcacagcacctccactgcatagaggtgagcctccagatgttttcattcattcaacaaatatatgtacctattgtgtgctgggcactgcttaagttgcgaggggatattgtgaagaaagtaagcaaaacccctttgtttgtagaatttcagtgagcatagtcctgggttaacctgacaacagtcctactgtttattgatgcttataggtgagcctatttctctttctagctttcttccacttaatttactttcttttggaattcttgaatttaataataataatattgatgttattagtcatcactataactttttattgagtatgtattttatgtcagacacagtgtggctaagtgctttacatacattatctcatctaatccttagaaaaaaccctggtgtattagtcttaatttaaaagatgtactttggaaaggttagtagtttacccaagattatgcagctagttaaaagtggtgctggggctgggcttggtggctcacacctgtaatcgcagtgctttgggagtctgaggcaggaggatcgcttgacaccaggagtttgagactaacctgggaaacatagcaagaccccatctttacaaaaaataaaaaaattagccaggagtgggggtgcacacctgtggtcccagctacttgggaggctgaggcaggaggattgcttgagccccagaggttgaggctgcagtgagccatgattatgccactgcacatctgtctgggtgacagagcaagatcctgtctccaaaaaaaaaaaaaaaaaaaaaaaaaaaaaaaaaaaaaaaaaaaagtggtattgggcctgtctaattgcaaagccacattctttactgcatgctttagtccattgttttttaaactgcagatcatgaccacgaatgggtcatgaaaccaatttggtaggtctccaacagcactttgggggaaaaaggggtagaatagagagtatcacatagtatggacaagcattgtttcttgaaatttttgtttttgctatgcacgtatatatgtgaatattgaggtctggtacaagatatatttctcactgtaggtcacagtaaaacatgttggtaagctactattttcttggctatgggactatatgtcatctaatcactttttaaaaacagattacaaactgtaggccttagaaaggtaagtaatttttcagctgggcatggtggctcatgcctgtaatcccagaactttgggaggccaaggcaggcggatcacgagatcaggagttcaagaccatcctggccaatgtggcaaaaccccgtctctactgaaaaaaatgcaaaaattagctggacatggtggcgtgcacctgtaatcccagctactcaggaggctgaggcaggagaatcgcttgaacctgggaggaggaggctgccatgagctgagatcacgccattgcactccaacctgggcaatagagagagactgcatctcaaaaaaaaaaaaaaaacaccaaggtaaagtaatttttcaagagcacaaaaatagtcagtggcagtacaaagacaagatgactgacttttttttttttttttgagacagggcctcactctgtcacccagactggagggcagtggtgcgatgttggcttaccacaacctccacctcccaggctcaagcgattctcctgccttagcctcccgagtagccgggattactggggtgtgccactaccacccggctaatttttttgtatttttagtagagacgtggtttcaccatgttggccaggctggttttgaactgctgacctcaaatgatccacctgcctcagcctcccagagtgctgggattacaggtgttagccactgtgccaggccagatgtctgactttttagcccttggtccattgctttattcttcacaccataccacttccttagaagtgcacctgggaatgcctgggaattgaattttatctttccacatgatggcagatatgctatggaaccttcagggatgtcggtgaaacctgaaaagggaagttgaatctcagcctgctctgagtaggtgaaaattctgccttggatcccccaaagtctgcagataaagatgtgacatttctcgtgttctgctgtgcttgaaggaaagagggtaataatcttaacagtgccaagctgtaagcatgttgcatatattaacttgtttaattactaattattttgatacagcggccatgcctgggatatgaactcagctgttttgagtgagaaggggcatcctaccagtgtgagttaacacttctctgtactctccccggttcctcattttgttcctgctgagttcagagctatgttcctcatagcctggcttacctgtggatgttctcagcctcattttcttttgctagatcatatatcttcattaggtgggtgattttggtttctgttactttttccttaatattagtatattgctgatttggatcaggggccaggctgtagattttcagcatggtgaggtgataatacatgttggtcccccatgcagaatgctgcctctagcactttagccaaaggagctctacagtctgtccagaagtactgggggacactggtaataacctgagaacacttacagagccttccagaaagtgccctttcacatcatataaacagatcatgggaagctgagggaatgcaaagtcaaggcctcattggagagcggaaaggaggctgagattggtggagaggagtggctgttacattctaattagaagaatgacatgtgcagggccatgaagcaactaaagatgggatgaaaaacttaacttgtgaatcgcaaaatttgagtaggaaggagctggaaaggcctggaagtgcgaagtgattggcccttggtcagatggctagaagatagagagccaggcatagaacccagaatccaggccatcattttgtggcctcttttatcctaatgacgttagccagaggtgtcttccaaagcacctgattatagggaagaatgaatgtcacttaccctagagtgagtgaaatagagatgccaggaagatataccaggtttatccagtttctttgcatttttctggcatactgtatactcttgagcgcatatgtatcctactttgtgaaatctgggggtaaagcaggacccttcaaacccttaaaaaatgtataccccaagaaaaacatttttaaagcatgaacgcttcctcaagtaaatacatatttatacattatataaatgtctggctattaaaccatgtatgcatatgttaactctaagtaaagcttattatatgttttttagcccataaatatggagatgttttaaaatttcttccagtgccccagtggatgatcttacacctcccgtgcttctgggatacacacatctaattttgcagaccactggtccagaatgtaaattgaagagtttaatgtctaagatatttgttcttttgtttgtagcttatcttttactccccacgtttcaaatatccgtttgcaaaataatttttgagttaaaattttcaattaaaaaactgtatccttgaggtagaaaagataaagatagaagatatatgtgaattaggttgtatctctccttaagagggaatactgttttttatctaaggagaactaacaaccctccctttcattgtctgggttggtataagtaaaaatccttgtttgaagttattaagccttcccacccatatgatgattagtttggttcataagctagagttagggcttggtaaaggctcctttttttttttttttttttttttaaagtctttccaccttaactagcaagtaagctagaaatgacagagcagtagaagggggaatctaccagagtgtcctacaggaccttgttgaatgctactgctgcatgcaagggttgtggatttggtgtgggccttctgcagtatcacccaaatttgagcagtacatgtaactaaaagtaagaaaaataaattagacagtttatttcatttcagactttggaagcccaggactgtggggattagctattagctaagacaatgattcactgagcaaatgcagtgaaagattcttttgttacactgatcatcatttgtggagagactctgaagaaggataaagctctggctgcatagtcaaaccagacctactactcaaggacatgcatactagatatgtaggtgtttccaaatatttttttcagttgtgggggtgcaaatcatttcaatagtagagtaactcagttcattactgttactggaaaaacaagtttaaccaagcacatatcctactgagggtgagtcaacagtgtcattttaacataagaaggacagtacatgaagtgagttattccaagtcctgtggttttcctacagctgagcaaagacagctgttctttcggaagtggggctctaaaaagaagttgcccatctcctttctttcttgattatagccttttagttttcttttggcctgagacatttcaaaaattcacttcctccttagatttctatcaccaaataccctgaattttgataatttatttatagagtatattatttattatagacttattatagtttaaaactttattttaatttatctcccatttcaagatccacgtttgctatatgtgtcagataataaaaatgccataaggaaaacagaggagtgatcttttttaatatgtcattattttctatagttctttagtggtatggacatggaataaggtggcattttgtgggacagtataccaaacttagtgataaaatttatacttttaattttggaggacaaaagtcttgtattctcagccttgtggataagacagtgctctgagctgtctgaggtttcctaaattgggattcaacatcatgaagggtatgtgtctggatagtttatttgttggtttgggaaggtgagtttttgtcttttttccccctctgagttgatttctttagttggagagaagcagaccagatgaagaaaatactttatctcttatggcatttttggtttaccacattagtgatgacccgtcttctctgagcagcaggccatgcttctctgttcagtagttcagttttcactaacttaactgcagatgtgttcttggagggatttatttctaagcaattgaattatgggtacttggataaaatgatgatgggttacctacttttaatagggccatcatttttaagagtaaaatcttgtcaagatagggtatatcatacttatgatctggttccatctctaactccataatttccttgtgctcctgtgttgctactctattattgagaagagatggtatcttgtcagtgtcaattttacaaagaaaaaattctaaacaatttcagtcatagggtagtttttttttttttcctggagaaataatgcatagtgtagtatgttgaatcctagagttggcaggttttcaaaagtggggttcttttgttgtgtaggtaggggtgatgctagtcaatgggtgttagtcattagggcatgtgtatgagtggtagttctgagatacagcattggcagcccctcttgtccctggttttgtttttgataagcaagtcctggttttgttttaataagcaggtcattagctgatctttcgtgtaaatgtttttgatgtgcatagctggtatgtgggtggttacctacctgagaatgttgtagtcacaaatgtatattatggaagtttgcagattatggtggatatcaggtttttctaactgcgtatttacagatgtagtgagtgaaaggaatgttgggtcagtaggtaaaagacttgtgctctggtcctggttcagacatcttgatttgtgtgactttgggcaagccccttatttctttgagttgcagtttcttgtgtaaaatggtgctaataccaatttacatgcctcatagtgttgttgtggggatcaaatgagatcactgtttatgagcagccttctcaggagtgagaaatagagggttgtgagctgactttctgatttgtttggctgaggtgttcacacaagccatagaatgctttgtaggcttgggtggaggaatgtagatggaaatcagctgaaaatccctgcctattagaagctgagatgttaatcctaaatatattctatggagtactatcagatgccttgcttttcttcatgatgccctattagcttcatcttcaggtagcataggtgcctgttactctcattttacttgaagaaactgaccagccaactgatttaggatatggctggctatcttctggaactcacattagagttactccttgagagtaaagtcttgtattttctgaaggttgctgcttttggggtattttccgtggaggtgggtgggcacacacaaaaactcactgtgctcaaatttataaacttgttcttcttaacaattttaaagccagattacattggattgggggaggggaggatactagatttagtgttttttaatataaaactttgtatttgaaactttatgtggtaacatatatttaggctcatagccaaagtgattacaatgcattggttttaatattttcagtgaggtaatgtgtgctttagtggggaggaggagaaatattatttaatcaccagcactacactaataaccacatttactaaatcctttgtccctttgcttgaactgagggttccttgcttttatactggttttccaaaggacttaatcttgttaatgtgatgaggtgatgatgggaaggacattcccactgggcccgaagtggtgaaactggtaaaactccctttgtaagtccctcttgttcaacatgagtgtcactcccatgtccctaaagtagaatggagttttattgaagagagaattttaagagtgataaacaaaagagatggaaatatctcctgtgccaggtcattgttaccattaaagactagaataaactgtaattttgcagattttctttttgtcttatgggaaattaaagacttggttatcctctctcggaggaagatagaaaactactgggcctgctcattaacagtttagcttggctgacatttttcaagcacttaccatggtattatagctgggctgaagctaggtggagcagacctcacttaggtgttgcctagctccagaatctgtcttctggtggaattcccttaggcttccagacaggagtggcaacaaagcagatgaaatggaaggtaggccagggcatctgctcgttcgctcgctcgcttgctctttctctctttcccttttctttcctttcctttcctttctctctctcctttctttcttttgcttccttcctctctctttccctttcccttcctctctctcttttctttttttctttcttttttttcttttcttttctttcttttctctctctctctttctttagcagtttattactcatttgtgagaatcagggaagcactgggctcaagaaagccaataccccttctagggcttaccccccattttaaaatttaatatattggaatttatattgtttcttttgatccgagatcttcaggctgaagctggagagaaatcttttgacctctctagaacaaagaaagcctttatcaaagacaatgtaactttttgagtttgccaaattaggtgttgctgcaaatggagaaacctagagttctcttctgtgcttaaagacacaaacatggaaagttttaagttccaatatggtcacttaatatatacaaaattttctgtctttgctgtctttgtcattccagcaacaactggatgagcaaatagaatgattgtgagcacttgcaaaccaaattgtgactgttagtgtgttgagctgcttttttattaaaatgactgctacaactctgcagaaatctgagtagtcttgaagataaattcttgcttgcatttacaataaagaaagaatatgagtaatcaaaaggctgatggagttggaggactggcgtttttaagaggaactgatttggacattgagattatcagctcctcatcaaatatcattaagtacacattattatttttttctgttgaccaggagacccaagttgtgttgatgtgggacatagttgtatgtctgaagaaacaaagcaagggagaataaaataaataaaaattgaagttcaggaatatatatatatatatatatatttttttttttttttttctcaggcagagtcttgctgtgtcgcccaggctggagtgcagtggcacaatctcggctcattgcaagctccgcctcccgggttcatgccattctcctgcctcagactccctagtagctgggactacaggcacccgccaccatgcccagctaattttttttttgtacttttagtagagatggggtttcaccgtgttagccaggatggtctcgatctcctgacctcgtgatccgcccacctcggcctcccaaagtgctgggattaaagacatgagccaccgcgcctggccgtttagggctatattttatgttttcttctccctttggtatttaataaagatttgatatttttctattatctgctttcctctgttccaaggtttttggcctcaggtgtgttctctggaaatggcaatgataggcatttataatctccatatttagatatttccctcacagtgctagtttctgagcttattagaacctaatgttaaatgacgagttaatgggtgcagcacaccaacatggcacatgtatacatatgtaacaaacctgcacgttgtgcacatgtaccctaaaacttaaagtataataataaaaaaaaagaaatatcctggctatgagtcaagggtttaggaccttttgaggcacttgggtttagacaattctcagtgatgtgtacaggaatttgggtacaggaatactattcacaggtgaacagagtttgattttggctgaaggcatattatttgatccagataataatataaaaataatccaaatgttaggaccttagcttctgcgaaccctgacttgagaatagttagccatacatgtagttggactttatgtaggactaaccaatctcctctgcactatttttgcacagtacattgattatggtatccctgatgacctctgtccccatccttgtgagtagccttcattgctaccacccaaggatgttttaaaaaggctatgaggaaggatgcatgtagggaaatctgaggttgttctttggattttccctgttttgttttaggaagtatccatgattttatataataatatgtagcaatcttaggtttttccattttcatttttaacataattttgttattcattctgtttgggtgtctacctctaaattaacaaacatgagaaattgtgtactccatttaaaaagtgtcctgagcaatttaagctaaaagaatatgttgtttcttttgtgtgtatagcaagaagattatatatatttataaatttttttccagcaagtgtacttaaaagcatgtacttaaaattaaggacttaaaaaaactaagctgtacttaacaaaataatctttagaaagctttaaggccgggcgcggtggctcacgcctgtaatcccagcatcacgaggtcaggagatccagaccatcctggctaacacggtgaaaccctgtctctactaaaaatacaaaaaaaattagccggttgtggtggcgggcacctatagtcccagctactcgggaggctgaggcaggagaatggcgtgaacccaggaggaggagcttgcagtgagctgagattgcgccactgcactccagcctgggtgacagagcgagactccatctcaaaaaaaaaaaaaaaaaagctttaaaaagggagtttactaaaagcacaggaaattggtgacaggcaaaatttgtcttgataatagtacaaatacagatagtggaacagaacagataatacaagatataagacaagacatggaataacacttcatattcactttctttgaccactaagcagcacacaaatatatagcactttttgtagagaataattaaatttctagatatgatacagcttcttcctctctgttgggttttattacactgagatcctgaaccttttggacatgtaaactgtgatcatgttggtcagtgtcatttggatctcgttggtgcttattgttctgccgatgtgtattagtgaacctactcatggggaagataatactatacaatgaattttcccattcagttggaatttttttattactctgttttctatgtttttcatttagatgtaaattattttggcttccattcaacctatttcagctagtttttaccataatacacatggcttaagatttataggaggctaagagtggagagtgtatcttcattcaaacaaatggtaagaaaggaactttcaaaactgttttagttttgcaaagattagaaaagtacaattctactttctcaacttttcatccttgttaaaggcctggaaatttgcagcatttttttctttcttattttacttttctaatttgttacacaaagtgaaattccacacataaacatgcaagctgaaggttgggtttattcataggttttgtcttaattatagatatttagtttattgaatatcttattgagtattgagtacctgctgtggtccaggcatcttcttaggtcccaggtgtacaaagaggagccaattgtggttactgcctctatggaatttgcctagaagtgggagagagagagatgagtgagccagcacttataatacatctacctaggataaaatgggagcacagaagaggaacatctgtatcagtgggtctctgagagcttcttcaggaaaataatgctttatctgtgatttgaaatatagtaggaatttagcaagatagagaaaaaggaaaaggaggtaaaatatttttcaggtaaaagaatgtacatgggtatagaggtgatcattattagcaaattggctacatcctaatttgtaagtatttgtggatttttcaaaccttatatttcatgtagaagagctgaatgcattagtctcatctccaagatccaggtattgaaatttaacccatgcataaattgaatttttttctgaagtctttaataagagaaaaataaaaggaaaaactacacagtgtatagtagatttcaatatagcacagcaaacactgatgaattttttttgcaatgagttcaatattataaaatagaacaaaattggaatttttaaaaccaaaaattattctagatttatcagctaactggaatgatttttttatagtatgaaaagtctgttagtaatacaaaaaatattcatttataagttgttatcgttgattatattttcttaaggtatattttcagtttttgaaaagcagtaataatttgctatgaccctatagcccagttcttaatatctggatctgatactagcatctcttaggtagaaaacacactttctatatgataatatctgtaaagagcacataaatccttggaacactattaggaaaacaaaatcgatttatctcttattgcttttttttggtttttttttttccttttaatcaagacaaatttcaaggaggaagacatgtttctccgcttcgtttttatttaaatgtaccacttgggatttgaagcttccgcacttcttctgtttgtttggatttttttttcatggcttggtcccaaaaaatggaatacaaaatttagagaaagttttgtttgaaattgcagggcgctatgagaattattgcaaatccctgatgtctctttgtctgccctcaattctcctatttttggtaataatgcaggcagtcattttagaaaactttgctttgttcattttactgagcctcttccagaggccatgtgccagaatcaacagcagccaaccacagccaagatcctagggcgtaaactcagacttcatctctcaaatattgctacttgaaatttgcataaacattgaagaaaaagttaaaagagcctgtataactcctcttcatgtattttaggagcctcagacagtcaagacattaaaataccttccgattgagcagtgggtctaagcacagataccacactgcagatagggagaaggatatgaaaaaaatcatgtgagatagacgacagaggcttatttgaagaagctacaaagcaacaagtaatgccagtttaaaacgattacatgttaatgcaacaagtaaaacacattgaaggctgctcagattacactggctgaagtacagacttaattactcatgttagagattcctaaaacaaagggaggcttttaagccagtgatatgtagctggtatgatattgaaaagcattggaaaacctaggtaaatgcctagaggaaattttaaggaagagtccatcaagtctggataccttagccttatccttaaatgaataaatttctgaggcgctggaactggttaaaatcaatggcagcttgttctgttgttggcagttttgatgtataattggggctgataaacctgaataaataaaagagccttgtctggattgagttacagttagtgctaaacatcaagggttcctattgtatttcttaaaagttctttttggagtgattccaagattggtattaagagggtatgccaagggtatatattggcaatttttattttgtttgtatttatcttagagtcatttgggtaggtcacattctctctgcccctactcccaacttctcattagattgtaaggaccatgaggacagagattgtttgttttatttgtgcttagttttcatgcagtgcctagtaggggacaatgctgacagtagtttctcgacaaatattagtggaactgtattaaaattgagtttttgctcacatatattgtttattttacctttagtggatcacttctccttatgccttcagtgctatagttttttaaaagaagtatgttagtctgttttgcattgctctaaaggaatacctgaggctgaataatttataaagaaaaaaggtttatttggctaatagctttgcagattgtacaagaagtttagagccaacatctgcttctggtgagggcccaaaaaactttcgtggctgaaggtgaagagggagcaggtatgtaacatggcaagagaggagggagcaagagagatgtcagtctctttcaaacaaccagctcacatggtagcgagaactcactcattactgtgggtgggcaccaagctattcatgagagatctgcccccataacctgaacacctcccagtaggccccaccttcaacattggggattatgtttcaacgtgagatttggaagggacaaaatagccaaactgtatcaagcacaaagaagatacagagatagtcaatggtggagctagtattcaaacccagatttgtctgatttctgcatccatgctttcaactgcttaactgcattgcttccaatactcagaaaagacgaaatgttttccatatcccaggaacttaaaagtgaaaaagcagagagctagaagaccctgtagtgctgaattgagagtcatgagtgttacaaggatgggtgggggggtggccctgtgaggaccagaaccctccaggggaagctttctgggtgaggcaagaggtgaactgggccttgaaggaatgggtagaatttagatagtaatgaggaaggcagaaatcagtggaagcacagacatgcatggaggaatggaactgagttcaatgacgatctgttcaggaaagagggcataaactgggcagagaatgcagtggaagtggtggggagtaatactgggcacgtaaggtaagctctgatctggaaggccagcatgggagcctagactggttaaagtaagaaatggcttgtccttggaagaaaaagtgtcaaacttggtactgtgtgaaggtactgcacagacctcccaactggttcttaggagagccaaactgaggctaagttctgagaactaagtaagaactgacagccattgtaggttagaaagtagtggggcaacatgttacaagtagtgcttctggaaggttagatgcggttagaataaaatcattgccattttggggagctgggaaaatggatgtcttcagtctagtctaaaaagggatgacttgaataagcttatataagaaagaaaagaaaaacctttttactcactggaccatttcataatcttgacttttttcaaacataaatctgtgtcatttttcttatttaaaacagctgagcagtttactctcctacttagagctgtgatccttatcatgggctcttgtgatctaaccccagcctgcctccctggcctctgtccttgcttaataacctctagccatatgaacctggaataccagtctaattcccacttcaaggcttttacacttgttgtttcctctgcctggggtgctattccctcatatcttcatgacacttgttcatttacattgtagctcaaagcatacctcctcagggaggcctttcctagacactatctgaggtacactcctgcacccccagccttcatgattgctttttatacattactgggttttgtttccaatggaacttatcgcttattactgtcctaaattattttatttattaattttttagccacctttctcttatagaaataaggttcctgaggacagggagtttattctgtatactacggtatccctgacatcagggcttgtgcctgccgatagtagatgctttctaaatatgttctgaatattagatagctagttcccaaatgcactgcactgaaagtgtatgaaaattggaaattggcttctagatttttgtattatattgccaaatgatggagtgatgagattgaaatctactacttctttttgccttttttttttttttttttttggtggagtagaggagggcctgcacaaacagcagatacacacacagtaaataagatttatttcagccagcaagtatttattgacatgaaaattggggttaaatgtgactctttgtgagtgactagtttcttggagtctattaaagcatcagtttaaacatcaattctctatggtatgattaatgtttctttttttactttataagcatgaagctgccttcaattttattgttaaatttaagtgttttacattggaaaaaagtaaattgaattttgaaatgaggtctgtcccggtctcactttcatggcttcaggttatcaaagttttaatttctctttgtatggaagataattatagtattcatttttgctcctgagtaaagccacgagtctcaagattatttttcttttttaaaaattagaattgtcagtttatagttgtatacatttatagggtacaaagtgatgttataatttgctaatacaatgtagaacaattaaaaggtagttagtatatcctttatctcaaatatttaacattttttgaaatttactctcttagcaattttgaaatgtataataccctattattaactatattcaccacactatgcaatatatctcaaacatatacaaaaaaattcttcttgtgtaactgtagctttttgtacccattgatcatcaggcccacagcttccgtaaccaccattttcctctctgcttctatgattttgatggttttcaattctacatataagtgagaacatgctgtatttgtcttcctgtgccttatttcacttagcataatgttctccaattctatccatgttgtctcaaatgacagaatttatatctaaaggtggaatagtattccattttatgtatctaccacagctttttttttttttttttttttttttttgagatggagtctctctctgtcactcaggctggagtgcagtggagcaatctcggctcactgcaacctccgccccccaggttcaagtgattctcctgcctcagcctcctgagtagctgcgattactggcgtgctgtaatttttgtacttttagtagagatggggtttcatcatcttggccaggctggtcttgaactcctgacctcgtgatccacccacctcagccgcccaaagtgctgggattataggcgtgagccactgtgcccggcctatctaccaccttttatttatccattcatctgttgatggacacttccataacttggtatgggtgtacagacatcttttcaataaactgatttaaaatatctggggtaaatacgcagcagtgggattaccagatcatgtggtgattctattttcagttttttgaggaacgtctgcactgtttttcacaatggttgtactaatttacattcccattaacagagtagaagggttccatttctccacatcctgtttattcagacgatatgttatcatctaaatcatctaagacctctatattatatagcttttgagtatttttaaaagtggacactcaagcgttcatatagtcatagtcagtgtgtggttcctcagacctgtggtatcaacatcacctgggaatttgttaggaatgcagattcccaggctccctgcagacttagtcagaaattgtgggggtcgagtctaacactcttttttaaaaagccctccaagtgattccagtgcttactaaagtttgagaaccgtggctcagtaaatgctaaaggttcaaggtagcatgatcccacacatcagccaagtggcattaattattagcctggtaagcccaccttcttttcagtcactgagtttgattggttcactagggctaggctgtaaagttatttgctagattgattgctacatattgactttgggttgtttgtatttctctgaacctgtcactgtaatgatttgtcaggacacttaataggaacaggccgtgatttttgcacccatggcattctgagtcatgggtggctgggtcattatgtactccaggtttcttcaggcactgggcatgccattcatgtacttataaggagggagctgtcgctggtggatcacagggaacctttagggacatttagttcgctctcagcttggtacaggtagggaaattgagcccccatgaagttgtgctttgcttgcagttaggggtacagacaggatttcaggtctcctgagtccctccactgcaccaggattcctgcagggggacagagctacagctttttctgtgcctacaggacattcctttcctactgtgagggttttatttatttattattttatttaaagaaaaaaagtaaatagaaaaaaccccggaagttctcactgaaactaataaaagtgtctaaagagaatgaaaaaatcagtttgagaactttggtatggaggaaataacctgacattaactgttttaattatagttgttgcattgggcttatcagtgtgggaagagggagcatttgagccttacagggaagtgggatatggacaacaagatgaccctcttcctgaatttgcctgtttgggcctgcagcctggtgactctttgtgtgatcccaacagctgtcatagagatgggttggacttttactgagacctgggtcctaggcccagcactgccaccagctagtggcgcgatgccccataaagaggccacttattctctctggcctctactattggtaaatgggtataataatatccaccctgccaatcctgagaaatttcaggtagtgggaagcagtgtatcttggtggttaagggcagagtctctggattcaaattctagctttctaactcactggcatggcagtaggcaggccacttatcctccctgttttctcacctgagaatgggtataatgaaatttacttctaagggttgttgtgaagattgaattagttagctaatttatgtaaagtacttaggatagtgccggtatttagtaagttctatgtgttagcctattattattactattaccatttaaaaatactatttcaaggatgggatgcattttctgtaaacatgttctcaaatgattctactactggatacaatactgggcttttatgcagtaattgttgttggaggagttgttctgacatccagcttgcacctgggctactggtttcgtggccagggatggccaggcctagcgtctctgatcttgcacaatttatgcatagagtggtgtggttagaggaaacttggaggggggaacttctcagttttgctttcaggtatttatacattaactatcataagagatggacatcttaataacttccaagaaagagttcatgagcttcaatttgatatttattgtttgactaggtttctttctgtcttacctttccagttgttagggttcttgatatgtattttggtgatgaaaatttcaactctaaaagctaaacaatcaagatattgtaattatccagcaagtgattagcagatttcgagtagacttcttccattcttggctgaaatcaatgaaaatgtctactattgctgttgtttttgttcttttctctgaaaagtctgtttttgggagggcctgagatggtaaagtgcctttttattgtctcttaaagggaatgggggaatcaacagtttgagaatttttgttttatctgtatgtataaaattgccttctccttttatttcttttgatactctctctgcagtctctattcatgatctactccccatctttttatgggccccttaaagctagagattatgtttattcgtttatttatgtattccatttctccttttttctggatcctaattttgtgcctggtgcatactaggctctcaattttagtttgtcgaattactgttattgctgtttctgattacttcttgaagcggtctgttttaaaacttcacctgaaggctaagtaattcatcagtataatggtgatctattatttatctagcattttcctaaacactcattgatgaatccttataatactcatctgaagtatctaaatcccaagatgatgtgtcatgtcatagatggtatggctttaatttttaattgggagatggagatgtaacagctggagatactgaaacacagagaaataagagcatgattcaagaccacaaacgtggttattgttggaagatagttttgggatgggcttctgtgctagaagccaaaacataaaaaactgattaaaactctaaaaagaaacccagattaggtgggaatgaatgctgatctggattggattacacttctttggtgtctgagggttatgattagtgacttacttctaatgtgcatttgtttttatttttagcattgcagtgtcgagatggctatgaaccctgtgtaaatgaaggaatgtgtgttacctaccacaatggcacaggatactgcaagtaagtttttctcttcatatattttctttttgcgatagaacactggacaagatttgattctactcctctatttttaatgcttctgtggaatgttactggttcttgagctttcctggtacagattttggttgggggtgaggatggaaggatgtggatgccagataattggctaataagaacttcttactatcttactgttatctttctcactatgaaaaagacttttcagtgagtggctagttaatgtatatggggtagaccaggcatggtggctcatgctggtaatcccagcacttcaggaggctgagttgggcgaatcacgaggtcaggagttcaagaccagcctggccaacatagtgaaaccctatctctactaaaaatacaaaaattagccgggtgtggtggcgcatgcctggagtcccagctactcgggaggctgaggcaggagaatgacttgaacccaggaggcggaggttgcagtgagctgagaccacatcattgcactctagcctgggtgacagagcaagactccgtctcaaaaagaaataaaaaaaaataaaaaaatgtatattagattcccttgtgtttttcagattaaggaatactcttagagtctccccttaacatgttacctattatcttgtttttaagtaaaaccaaatagatatcaactttaatattcggcccagtatatgtgaatattatattcatatttttttctagtgtaaaaaatctaattctgaaagtgagacagtgagagaggaagatgtgtgcatatgtgtagattgagggggagcaggggctttgggtgtgtattattatatggggataaaagagtaaggatgaaggaaaatgtaggctagttcttggcttaagagcatttttttttcctttttctccaaccatctactctagccaagacgttttgtttgtttgaggaaggctgtgagataatttcataatagcttttctatgtttcctgcaaataattttttttcttctgcctcaattgaaaatttttaagaggaatatgtatccattctgtttatttcagggaagatgctggagaaataaaatttggtaatatgaaatttctcttcttttccttcatttttgtgaggagtagttcttctttgctttggtggaggtacttgcttagtaagcattttaagtgagtttatccaacacatttttatttcttaccaggaatgtaattacaacttttttccagtgagatctgttctgacaccaggatttagttttttaatgttataaacaagatttttttttcaagtcagaaataattttcttcactaaagtgaaaattaagctgtgatgacagtaaagcttaacaataggttgtttggattggaataaagataacattggaaataaaggttttatgtagcttattatgggctgctcatttagtttttctagctgggggaaaaaaaaatgtggtgcattctcctctaagaatggagatacaactggagataataagggagggaacttaataccttagagtaggccactgaaatcttgtttagtctttttgtggcatttggtgcgttagttgcttgctttattctgttatgcaactcttgtggtagttaaccccattgcattatggtcatttgttgatgtgtttcttttgctagaatgtgaggtcttagtcttatgcattttttgcatagttaatgcctagtacagtgcctggtgtagttattgttcagcaatgtgtttcttaaactaaaaggtgctaagtagataccgtcatgcacatgtttcttatctatttatgttaaataagaagacactggttctctcctttaaaaatttcagtgtggcgattcctcaaggatctagaaccagaaataccatttggcccagcaatcctattactgagtatatacccaaaggattataaatcattctactataaggacacatgcacatgtgtgtttacttcagcactatttacagtaggaaagacttggaaccaacccaaatgcccaacggtgatagactggataaagaaaatgtggcatgtatacacgatggaatagtatgcagccataaaaaagaatgagttaatgtcctttgcagggacatggatgaagctggaagccatcattctcagcaaactaacacaggaacagaaaaccaaacacggcatgttctcactcataagtgggagttgaacaatgagaacacatggacacagggaggggaacatcacacactggagcctgtcagggggtggggggaaaggggagggagagcattaggatgaatacctaatgcacgtggggcttaaaacctggatgacgggttgataggtgcagcaaaccaccatggcacatgtatgcctatgaaacaaacctgcacattctgcacatgtatcccaaaacttaaaagcaaaattaaaaaaaaatttatttatttcacatagcattcagggtggtaataccatacagagaggcaaattggttctatttgaagatcattcaacttggtgacttatatatggagaatttcaaatatgttctaagtgttcgcctatatatttttggtctgacatggggagagaaggtttctaggggagactaatctctgagcacttaccaggagaggacacctaagggtcactgttgggaagaagtccaatagttctttgttggactgttgggctgctagtctcatactctccaaccaaggttggagaccatcctggctaacacggtgaaatcccatctctactaaaaatgcaaaaaattagctgggcgtggtggcacgcacctgtaatcccagttactcgggaggctgaggcaggagaatggcctgaacccaggaggcggagcttgcagtgagccaagattgcaccactgcactccagcctgagcgacagagcgagactgtgtctccaaaaaaaaaaaaaaagaaaatggagctgcctaaattctgtccctggctacttgttaattgttgataggatggaatgcttatggatacagttctgggtatgtccctcagatgtctttcctgttttgagggaaacaaactccttgagagaaagaaaaaatttggtgaggccatccttttgggagaccaagatgaacaacaaaacttgtataaagagagtgattccctacctcagcaaaagtaatattagcatatttaggagtggcagggtcaacataagtggacaaagaaaaagcaagaacaatatcaaggcagccacgtcaatcattctacagtgctttgccagcctccacagaattttaagcaaaattttatgcaaaaataatgtgtacctagcagagctttcagtgtattttcaccaaccttacctttttttctgtggagaaagaagatgatctagcttgttcagtaaatattattttcacaaaatagaaaatagatattaaaacagaagatttataaaaattctatcaggcatgcagggcatgtgattatctttttattcatgcgattgcttagtggattaagaaaagaaagttgaagccaaattccttttacagggccagcgtgggggtgagtggtgagtggtgggatgggaactggtagaaagtgttttaaaatagaaggaatctgactatctgtttagacagcataatgctactgattcagctaaaatataatgattgtttatagaaattataaaaatccttgataagatcacattgacagatgaagataactacttttgaagattagttttgtactcagctcaactgttttttctcagtgttaggagcctaagtaccctatcagtctgtgattagattttgatgccagattaggagaacttgtataatcttgcataaaactcaattattgctgttaaataactactgtcaaatcttaataaagccctctcactacagggagataagatattttattctttcccttgtcctactgggaggtgtaaatatgtaattaaatttgatgtcattaatcactttcaagttgtttgcttcagattttcaaatataaaccattctaaatcccaatttgattaaagatcatggacaactcaagttcactaggattctgggggtaggttaggttatgatttgtataattgacaaaatatgtattttaaggacatttattgtagttatttaaaatctttgtctgctggttcttaacatctgggttgtctatggatgtgtttctgtttctatcacctgctccttctttggaccatgggtatgacttccctttactttacacatgtatggtagttttacattacttactggacattgtgggtgatagattttaaagtttatctcccactaaagaatgttgaattttgtcaagattggcagatcatcttgatcctatggatgctaggttttaggacacgttagggtgggcctacttctgttctgcccttagtccgatgacacaaatcttagtcatgggatagggctcttattcccaagatgtgacccttctaggggttcagtggaaagtgtgaggggcctaccaagccctgaggtgttcattaagcccctctaaggcagaacttgtcctcccagccccaggagccttctgctcagtcttttcagccgtccagctcttactttctcttgggtttctgaatcttatcttgctcatgcatagtcaggaattatttaaggatttgagcagagttgtatgcatactttgaagctacccactctgtggttctgtcttttccaggaatttttctcctcatattctagctgctgtgacagctccagatacctctgactcctcagtatcgcaggacttccgttttctgcttgcacactcttcctcttctgctgcatgaactggggtgtaccttcacgataaaaaaaaaaacaaaaacaaaactgtaaatgtgggtttcatatagtttgcttcgctttttctgaggcttatatcccttctagtttatgcctgctttcagtgattctccagtgcctttgatattttgtccagagcaagagggctagtctgatatgttactctgcaattatttttaatgatgaaaattggaaatataaaggggcctttcagaatttcatacataccacttggtaaatatctaacatagtgtttgtaaaacagcagaaagtcaccgtgagttgtatacgttcctgtagatgggtgcttgcatttgagaatgtccactttttgctaaagtgctgatctaaaaactacactttaaggtaaattattataaatataaagtgttataaaatataactttgtgtcacattttgtctaaaacttgtctgctagctgtaataaacattaaacattaacagctaacaattctccttgccaggattaggcagtcatgttggtggtccagatttcctgaatccatccaagaaaaactagagccattgccttctttgtcttcttggtaaatgtctgtatagtaagtagagagtagagacactcataatcccttagaacttagctttttatggaggatgcattcgcaatgtttctgttgtggtgcttctcccccaaaaaggcgttttcagaagtcatggctgactcagcatttccccctttccttcaccttcttgtgagtgcattcagggaggcacaggggcattgtcagatcaaagaaatagacagggaaaaatatcaactgttaaattactttctctttcttctcagctgaaactggttctgccagcctagttccttcaagtacggtgcctatttagctgaacattgtgtgtatagtttttctggaaaatgatagcagaagcttggccagttttccatagttcatttatctttttaacataaaacaaagaatgctgtttttttggctcattaaatacctctcatagagtaatcttttcttaaaatgtaatatgttcaggttttattaattcaagagttatttattgcatgctatttatgcgtaccacatataatagataactcaagtctgtggtagtagttgcagttaatcaatattgttatcatattatttcacacttctttgggaagtcataaaataattaccagttcattaacttgggcttcttagagaggttcagagtaaagccaagtatgaaaaaaactgactataatgtggccttctgtacaggggccaccagtgaatggcagggctgggaccatggtgaggcaagtaaggcacaggcctctcttgtgaaatttaagagagtgccaaaaaactcactaatcaaaataatgtttgtatgtagttgttcaaaaaatcaaaattaatgcaaaataagttgaaaattatcaaaattttaaataaggagatcagtagtactgattttttcttttgccttatgacctagtatggttcagcctgcactggtgagtggagtaagggtcctggaagatccttgactggtgacatgaagaggacatagttttttgttgttgtttttttttgagacagagtctcgctctgtggcccaggctggagtgcagtggcgctttcttggctcactgcaagctccgcctcccgggttcatgccattctcctgcctcagcctctcaagtagccgggactacaagcgcccgccaccacacccggctaattttttgtatttttagtagagacggggtttcactgtgttagccaggatggtctctatctcctgacctcatgatctgcccgcctcggcctcccaaagtgctgggattacaggcgtgagccaccacgcccagctgaggacataggtttttttatgccagatagacttaagtttgagtcctgattcctattaacaattggatctttggcaagttaaagtctataatgctagctaacattattgcgtattagggtctgttctcaagtagtttacatgtatttactttagtcctcatgtgagagagagactatatggaagctaagagaagttaaataattcactcaagatcccatcactctgtagctaacctgagatatactcgtggaaaatgtactgtcacgttgagtctcagtttgcctgtcaataaaatgggacagaattacctgttttaagttggtagttcaaatggaaccttctgaaaaggaagtgtggaacatttgaaagtatacaaaaaggggacttttcagatcaggaatatgattaaaacactgctttatgtaatttctaaatttaaagacagtagcattaggtaggcctgagtacctcatatcattctagaacactaaatctgcatatagttacatgagtgtacatgggccaggtttggtgaatactgcatttctgagaaatggcctttaacatgaaagctcaatgtaataactgtggatgaaatagaagaagagggcagtgaaggtggggatagaggatattgtctattaaagtgtgcttcagtagagagaactaatttgaaacttctcctttctttttactaatggaacaggagcaagtccagacagatttatgcagttgtgaaattgagacaggttaaattcagtgatttttgataaatgttgttgccagcacaaaagtcacaagttgttgaatatggcaccttacatttgcatagtgagttacagatgcataggagtatgtcctgtgaggcttttccttgtattaggacttgagatctggaccctttaacagtacctttcctaagtgattcttattaatacttatgtcctattaaaatcctttatcaaatatgatgtttccctaaggggtcttttgtaaaggaagtcttggttactagcatctccatctgtggcccaggcttgagtgcagtagagcaatcatggatcactgcagcctccacctcctaggctcaagccatccatcctcctgcctcagtctcccatttttaaaactttttatagagacacggtctcacatgttgctcaggctggtctcgaattcctgggctcaagtgatcctcccacttctgcctcccaaagggctggaattacaggcctgaaccactgtgcctggccagttagtagcttcttaacacatagcaacataatttccatactattttcaactaatttttattctttcagttgggacctttatatatttcagtgttcagtgaagaagtaggagaatctggttcttaggctctgcctatatccttttacctgtcttgggtaactgccaagaaattaaatcaacaaattttggcctgcagtctggcattaatagatgtgaatttagctaggtttctttcaacacagtctccaggtcaatcgtaatcttatgtgaagtttcttattcaggcatgtctcgttagcaccattaatttcacacaggaattctttttttctccctttttttgtgactaagcaaaatgagaaatatttctctttcaggatatggagaggcttaattaaattctttaattttgtctacatctgcccttatgaatgatagcaaaggaatgggggatatcagaatatgagaaaaagtaatcatctaaaaatttccaagcactttaaaatttattaagctagcataaatatgtgggtgtgatagaggttttcattaagcctcctctcaacatacagtagttaggaatgaagtttagtgtctctccgtcctcctgtcatatgtgtgtatgcacacgtgtgcacatgcgactgtgttatgcattttgttttcatatttcttttagttgggttttaccttacaacccaacgtaaggtaaattaaaatttctattggatttccgcacattttctagatcctatttattcactgtcagtgaccttcactagcacttagtcctctgagtccaaaaatgtattgccaattcttagactccatcagccttctcctatgaaaaagtaatgcagttaatttctgctcaaaatgctcttctcctaaacagtcttctacttgatctttatgaaaagagttttatgaaagaaaagtgaaaataaagactaagaaagacattatttaagtgatgggtgatattattcagtgaacacattcaactatagcattctatccagttttttgccttcacgtaaatatgaggagaaaggtaggtgttaataagaaaataatctgattaggatttatgtagaatggtagcatttagggtattaaatctgtatagattcaggtcattttcctgcagtcactgtctataatcctgtgtgctgaacactgaaagttagatggactctgaagcgctatagaatcctcacttttcaaacaaaagtttaatttttatcacactagtatttattgagcaggctactataactgatcactgtactgggtattgtgaatagacagaaaagcccaagaggcctgtgttacctgacttctttattcacaagtatacgtacccagagactgtctgacagtgaatgcagtttctcctgcataagacatggtggcagtcttctgaagtcttgctggggagatgaagcatacagagatgtgtaaaataaaacagtttgtaatatcccagtgtaggggcacagataataactatggacactcagacaaaggaacaagtactgtgggacaaaagagtaaaatcagaggacttttggtgcactgcttagatcctaaatctttgaatattagtggtgccttagaagatggataggtaggagaagggtgagaggaagggagctgaggagactagaagggactgttatttcctggaataatcattaccaatttcttcatcacgttttcttaatgacacggtttcaaacgttttcttcatcttgattgctgtcttctgtgtatatgctggtttgtgtgaggttttactaaaccagtatgtggattaatctagtttcacagtgacaggtaagtgatttagaaaatcattcctttagcacatgttaacttgaacgtttggaggtagaatgcctagagtgagggtgaaggagaggacctggggacaggaagagagggcagctgggagcaattatgctccttccctcagacctttttggccttgactcttgattcttgtacttctaccagacagagaggcggtaggcttgtggccatgttttgcgaggaaaatcagaatctaagaatctctaaggcaagagcaagaatggattgggataggggaagtgataggaaaacagaggcactaagaagagggttggttttcatgtactgcatagttcattcccttagttgagaaatcaggtatctcaacctcagatatcttctgtccagcatatcgctggccagatctgattcatatgagggatccagagtaaggaagcatctgttagccaagtctttggttaccccaaattagctcaggtcctttactgcttgtttcctctgattatatagtacatatccaaaccctcaattttccagaataaactaggtctgcctattctgtgtggaaaacatttgatggtggttaagattctcttgcctagacgatggtagtgccttagtcgtttaactgcctgtcactttaagattttgaaatactgattcttgttgtgtaagccagacacatcttgagaatattttacggggcaacttgccctttctgaaacctcagtcatcctgaaaagtaactctgtacctccttgactttaatttttctgtcttaattctatttgtatacaatgtttgtggtgtctgattctctgtctcgtattgctgaaactcatggccttgaatttctgggtcactcttaaaaaatagacataacttgattactaatgaaaaagtgactcattttcttccaggcaaaggctgacactgactgtcacagtttgtgacagaagcagactctctaattaggagacatcacctattcttttctaaattttataagaattgatgatagcatcatgagatgggaagtgagtaagataagcgtttatgcttgtagagaggatgcataaaaatgaaatctggataaagttctatctgaatttacctttttaagtggttgattccctgtgagcttaaatttagtgcttctcttcccagaccgttgtcttacatacacacttcagtcagttttagccttgtataactaatcagcaggtcagattccatcgaggctgaaatacctaccaccattctatgctcaagaaaacaggctctcatgttggccagttgtttgggatagaagatggttagacctttctatcctttttaaacacaagattctttttcattccccttatcttgtttaaatatattgttccttctctttggttgttctttgctttcttatgcatctgtgaggggctagctgaaagtgtgagttgtggaacaattcatttacataagtgtatattgaattatctgtgcacctagagggtgatgggcactgtgagggatattaaaaaagagacacagtacagttcttaccctaggatcccctgcttggagtgggacagtggtcaagacatatacaaccacaaacacccaaacattaacatcaacaagcatcattacatccttgggtggtattgccaagggacttcaaaggccaagattatagagtcatcacacttaggaggtcaaagggactttggaaagcacctttgtcactcattttgttttataagtgaggaggctgaggtgtaatacagctaagcgaattagcctttattacataactcattaggatgtagactgggactaagagctgtttctccagatcccattaggcaatctaaagattctgcactatttctttttcatttttggtatccaaataggtacagttgtttttgatctaggaaaatccttttagactaaacagtaagctttttaaattactctgcttttagatattttttggacttcagaactttgaaggtggtcatccaccaacattggggaatggaaagaaggctccaacacttttctttctagagatcttctttaattttcaatggcagtcactacagaatctagcagttcatgctattgaggccactttgtaggattttttttttttttttagtcagggctccaggtccctggtggtttatgtagtcagtcttatcaacaaccgatgaaagaccaataaaagtgcaagagggaatgaggactgtgtgtgtgtatgtctgcacatgcacacatgcctctctgtgtgtgttggttaacttcatatttggtaggtgggagggaaggtgattaaaaaataatctactttgcatggagttggcccaatttgactgatataggggtgagtgggggttaagaagtagtctatatatcaggaatcttaattagttttgaaaatcctttaggtaaatagctcaacccagttgttcccaaacttcaagtgtatttatagggtctttttaaggggtaaagattccacagagcccttcattttgaccttttgcttctgcactgaatagtcgaatgccttctatatgccagtcattgtgttaggcactgggagtatgagaattaataattttagtctgttgacagataatcataataagggctaatgagtaacacaggctcagggttataagaacagagggggtgtcaaggctgtttttcacaggaaataacatttaagttgatacaatgaaattttagggcttagccatgagaaggtggggaaaagcattttgggctgactgaacagcgtgtacagaggtctggaagtgagaagtagtgtactatagcattttctaggagctgaaaggcatttagcaagagtatagcgcataaaggagagagcttgagatgaaacaatttctcagtgtgttgtttgaatacaatgtatactgtcaaaatctaagaattcaagaatcatttaatatatctttatgttttactagtcataaaagcatatacatatatttaaatatggacaagatactgtttagtagtttagaaagtgatttatgaggattgcaatcccttgcaataactccacagcccataccttgggaacaactgagctaactcattcagttttgtccattacatcgaagggtgttttttgtaaactcatatgtctagaatgtgtttgccatgttttaatcacaagtagatattttctcagagtccagtgcagtgaagtatggtaagatcctgattgtgttctggaacacagaggaaagaccaccttctgttatagcaacaacacaagtcttttaacactgtgtgccccttcccaatctttcaagtgatgattgaagagactaggtgctcagctcagcctttgagttctgataaatgagcccagactgtaaactggaagataaggatgtttgtaaagttcttgtataaataaagcatggtttctcattgcagtggttactgatttcatagtctgagtgaagatgaatgatgctgtgaatcaacagctttaaagtccgtaccacttcagcttctttttggtttaggtttcttaaaatcagtgtgtatttaatgctttattcagatgagggggtgaaaaacctaacacatgtaaactaagtgaggtggggtttcagagataattcccagcctcacaattcctcatgaagttcttttcctgtgggaaacttttaatttggaagcatgcaacctaatgtgggaaccaagattaacattttctgaaatacttctacaagaaaagcagaaatggtctgtccaggaagctgaatttacatagtagaaaaatgagctgccctgcagtatttggtagtctttgtgtattggttgtgataaaagtgtgtatgtgtgtgtgtacgtgtgtgagagtgagagattgtatacttgtctttgtttccttcacatacaactagtaaggccctagaaaaactacactagaaagtgtgttttaccacaagcgtcccagttctggacaccaatctatacacaaatacttttttttaaagttctttttgtttttccttcttgctgagtaagctatagtatttccttttttttctttctttttatttgagagaagggggggttgagagtagagtgggaatggcaagaagtagtatgacagagcttcttctctttttttcccctctttaccaggaagttaactagaagtcttcatgcatgtttttaaaacaaagttggtaattagcataacctagttagttacctttacacagagtgacagaattaaaaagttgacaagcccatcagacctcagccaggaggtactgaaaggagggagaccagtgagtctagaccaataggtgggttaggcctcctgaatgccagcctagaagtttagacttgattctataggctctagggtacctacaagtttgtagtcgcagccttgggaattgaatgttacataggaactttcactggttccagctagccttggctgttagcaattatttttatctactttaacaggggggacagagtaggggggcaggaaactaagctggcattatggtcacaggaaagaacagactgatttggagcctttcaaactgcagacctttgttactgaccgatgcttaatttggtttctgggttttgttagttttttcccctgcccttacctcatttaccttaacgacagctcccccctctagagctcagctagggcaggctgccactgtggattggggggccaagaggcccagtgcaagaagaaagtgggttgaaagcagagttctgtttaaagaattttctgctggaaactagcccagagggagtaaagaggagctttaatgaggagcagctgcagtgccgacgcaacccacatgagacttttttttccccttcgttccacattctgtatagtttttttaaaaatcatgactttgaaatagctgttttgtaaagcatgcctctctttttcttcttgtatgtggtgggattttgctttgttgttgttgttgttgtttcttgaatggccaaatcctcgttttaaaaaaaaaaaaaaaaaaaaaaaaagctaaagacagagctgcagcaaagccctggatgcaatttggcctcaccctgctgatacagaacattcggtggagaaaacaaggggagagaacactggcttttatttggaaaaggggcttatttcctgctcagacttcagtcatcttggagctgacacaagctgctacactgttttaagcttttctgtagacgagtggctattcacttaggaaacgtgaaagaacaaatttttctgtcctgtattactagagagactgatcctgaactgcagccattgccagatagattggaattgctattcagatcccagcttcgttgaaatctgtaaagtggctacatgtaaactaatccaggctgctagtgagatgtgagggttggggtctggttttcatctgcttaagtgagaggaaactgtaggggtatccttcaaatggaatgttttctagttccattaggaggaatcccttgtttttctctgttttcttccttcctttgcttttctacatccaaccccatgcgtatgtttgaacagtaacaatggaaatgtggacctctcaatgtcagaaatgacacttttttttttttgagatggggttctcaccatgttgcccgtattgcctaggcaggtctcgaacttctgctctagcaatctgctcgccttggcctcccacagtgctgggattacaggtgtgagccactgtgcccagctgagacttttaaagaaaaagtcataaatatatctttatggacctggtaagtattcagattagtttatagagtttaaaatggaaaaatgctccccaaacctttctctgtattcacaacctcatctgcgaagtatgttctttcagagttccaatgctagagaagagagagtaagtagaagtcactgagagacattgaagagacagttatgaaaataattaataaactccctacaggagggaaacattcatatagttttgcggatgaaaggcatctgttagatttttgtggttattttttagaatatacacctttagttcaagtggtagactattttccaaaatgtgtgctgggtagcttaatggaattatagatacgtaagggatgttgggtgtttagccatgttttcactctctaaccaaattcaactttagccatctcaagaagacagctatttaagcccttgttttcaagcagagaaccttactttccaccaagactaacagagtatattttctccttataccacagttgaacagggatttgcaagttgaaagatctcctgccttaggaaacaagggtctgttatttctgactgtcttagctattactcccctttcttcccatgtccataatgctgcttagcttcctggggtgtgaaggataattctatacctcaggatgactattaggttgatttggcctgttattctaccagacagatcacagagtagagatggattttgtggaacatttggattgagagactgactttatccatcacatgaaatttagcctgctttggaaccagctgcttagtggggtttatgtactcaggtattcagggaacctacaccaagggttcaagacagggtcttccccacaaaaactatctagatgggagtttgagaaaggtacagcaaagacataacagtggcttaaataaagaagaaccataccagcggagacaatgtagtgcatgacatggcactacatctgctgttggaaggatcagagacaggtgggatgatttgtagaaggcttactataggacaggtttacagcagatttttgaaaaaagggtggaagaaaggaacctaagttggagatataccagaagggaagcatgatgtttctcactggaaattaaaaagatttcaatataggggacagtaaacaagattgtggaaataatatggagtgttcgagttatggattactaaagagtaagatggttagatgattggaatgggacagacaagcagatcagagattgtaaagaacttggatttgaaaggcttggtattaatactgttgctagtttctgagcagaagaatgacatgaaaattatgcttaggaaagattattcttttagtcatatgcttaggttcagcaaggaatttccagactgtccttagggagaggagaggtatggataggatgctggtccatttaggatgttagagctgattgaataagtgctagtcttggggcaagacttagtcatacactttcagttaagtactgtttcattgcaaggtctaggtgaagatagggatatatttgtaaaactggggaaattgctagattcacagataaccaactttgggtagatcagttagctttggtgtccttctcagtgctataggggttcagaccatttggtttctgagatcactgctgaaattctgtgattgtatgagtataatgtaaaagttgtctcaatcaaggaaacttggagtaaagactcaatatgatggatttaaaaggaatgaatgatagttccaattattgggttcaaaaaacatgtgctacaagtataagatgagaaaaatagggtacactagtagttcatgtgaaataaggctctgaatattttagctgagtgtgtattccatagcacatagtagtattttgtggcttctaaaaaagtacacatatccattgggtatgagtcggagcgttattctttcttgaactgcgctctcacgatgcctcctcagtttaagaacttactctgaaatagtaaaagcatagtgtccagatcaggaggtcatggttcagctctgtgctgcactggtaagaacatgtgttaagcctttttccattttgagcctcactttttaaagaggtttttgatgaactggagtcatccagtgatggggaggcaggatagcctagtgttgaagcacacgcactctagagtctacttgggtttgaatcctgcctcttccatctactagctgtgaattttttttttttttgagagggagtctcgctctgttgcccaggctggagtgcagtggcgcgatcttggctcactgcaacctccaacttctgggttcatgccattctcctgcctcagcctcctgagtagctgggactacaggcgcccgccaccacgcctggctaattttttatatttttagtagagacagggtttcactgtgttagccaggatggtctcgatctcctgacctggtgatctgcctgcctcggcctcccaaagtgctgagattactggtgtgagccaccgcgcctggcctagctgtaaaatcttaatctttctaagcttcgagttcctcatatataaaatggagattataatatagcactggagcgagtaatacaagagacaatagctatcaaatgcttagcaaatatacaatacatagttaagtacttagaaaatatgttttcagttacttcgggtatatacctgggaagggaggcagaaaattttggtcattctgattattattactactgttaagcatagaagcaccactaaaaaggtgaagaagcctggaaataaccctatactgaggaatatgccaaaccattgaatcctggaaaaaagaaaacaaaaggcccacataactatcttcagattcttgaagggctacgtgtaagagaagcagaaggcttgttcttttttgttctagagggtagagataacctggaaattgtagagagacaaagtttgttcttttcaaagttaagacataatttatgtatcataaaatttacccttttaaagtgtttaatttagtagacttcagtatttccagagttatgagaccaccaccattatctaatttcgaaacatttttatcaccctgaaagaaattctctactgcttagtagtcactgtctatttccctttctttacagctcctggcaacactaatctactttctatctctacggatttgcatattctggacatttcatataaatggaattatataatatgtggccttttgtgtgtggcttctttcacttagcatgttttcaaggttcatccatgttgtagcatgtatcagaatgtcattccttttcatggccacatatttcatttatggatataccacattttatttatctgttcatccgcttataggcatttgggttgtttctactttttagctattatgaataatgctgctatgaacatttttattatctgggcatatgttttcagttatctcgggtatatacctaggaagggaggcagaatttgaagaattaagaaagagctttctcacagtggaatccacccacattgaagactgttcttttgttgaagtagtcagccagtaatttcacttaacaaatgcatagtgtttactatgtgctggatagtgttctaagtgctttacccttatttaaaaatcctatgaagtaggcactgttattacatctcttttacgacagggaagtttagtaccttgcccaagattacacattgagtaaatggtggagttgggattgaaatccaggtggtctggttccagagtctgtactcttaagagcagaacaataataactccaagcatttattaaattctcaagatttatccggcaccatgctacatgcttgtattcaagcagaggctggtgatcatcttttagaaatattttagaaatgattacttaattggatagaaattaaatttcttgaatctgaaggttctgttattccaaggatggctggaaatgggggaaaagccagcaacaagatgatgtctggcctgaggcttttaagatgatcagaatttgtatcaaaaaggaaactgtgaacacgaatgataagtattataggaattcagttaacaagtcttgtcagaatgtggtaataaattatatacaacttaaagagatgaagttactttaaattgtgtgtggaagccttagaaaaattgaataattaaagtttcttgggaagatgatctccttttacaaatgtttagtttcaaatagtggcagcacatattaggatagagagatgacttctagaaaactgaacatatgggactggaacagtgtattttggagtcagttacaggaaggaagttgtttaaaaccaagtgaacaacaacagtaacaaatgcatttgagagaaagagcagtgcagtccagacttaaacattagggtggccataatagatggggaagaaggagaaatcagcaatccagactaagacttcactgggttttgagttagacagagggaggcatagaagccaaggtaaaatgattaaaacggtacatggagtggttagcaattctccctataggagagagaatttccttatgaagtttcagatgagaccactgaacttgactagaggaaagtcattgtttttagaaaacagtttctaaacaataattagaattaaagttttgttgcagagggataagtaagaagtagatggaaaagaaagaggaatatctgaaattaggctacagtcatagaaggttagctgtgaaacaataatttggaaagggaaatgggacctcatgaaagtgtgggttaaaagagacttgtatatcttctaaggtaaaagtaaagaactaagctgatgtccagccctctaaaacattttaaatagaaatcaaactttattaatacagtaggtctagtttcacgtaaagcaaatatatggttctgtacacgggctttaggagagtaagtctgttgtacctcatatgtaagtattatcccatttagaggaaaaccctaagtctttctttacagtggcttaaaggccccaattgatccacatcccagttacagctctcatctattttctgctgctccagatattcttgctgtttctcaaacacgctagggctgctctctgtgttatggcctttgcatttgctgttccctttctcatgaatgtgttttcctaagatacctgcatgattactctcaccttatttaggtctcaactcaagtattgtcagtgaaggtcttctctgattttcctattctaaactgagatacttctctttgctcaccccacaccctcatccccagctccattccttcctgtttaattttttttcacagcacttaactccatctattgtgcatcttttacttagtaattttgttttcgtcttccgctattagaatgtaaactccaagagtgtaagaatttttctagcactggaaaaatgcctggcacataataggcatttactaattgttgtgtgaatgaacgattataagtttaatattctttgtggaaactaataaggttgatttcctatcagaaaccgatcattattaataagcatattggatggtatttatagaattagccttcatatgttctctactcagaagttggcaaactttttctgtaaagtgccagagagtaattatttttgcaggctttgtggtctcattacagctacttgactctgttgttgtagtggaaaatcagccatagacaatctataaatgaatgagcatggctgtgttccagtaagactatttatggacactgaaatttgaattgtatataattttgaaatgtcagaaaatatccttcttttgttctttttttctaatcatttaaaaatgtaaaaaactattcacaggccaaacaaaaacaggcagtggtccaaattagacttgcaaactgtactttgtcaatctctggttttactgatttcttaaatatatcttaggttaaaacttatttttccatacttgatagggagcaacaatgtgaattaaactgtagaaacaaataattcagaaatacatctgtttagctttagaaacttccattttgcttcatttttgttttcctgggaaccttatatttccattatatgtttatgatgctaccatttaaatgactttgcattctcttagcatatgccacatgatagtgttagggtggtgtaatagttcaggagcaaagctgagcaaagcccacccacgtttaaaaatttgccattatttagaaggtgcataattcccatatgggagaatgaagagtcatctaataatgcccagagggctgcactgtgagtgagaattgtgttgcagtttttaacattcataacacatttcttgaataagctgcaaatgcttttaataatatatctcagagttaattttagctatgctacattggcactttttgctcctccacttcaaaaaaccaacacaagaaactattctcaaatcaagctgtgatttggatggggcattgtattttcctcaataagcacaaagaagagagaaaagatgttttcacttggcaaaacttttttttttgagatggaatctcactctgttgcccaggctggagtgtagtggcacaatctcgtcggctcactgcaacctccgcctcccgggttcaagcaattctcatgcctcagcctcccgagtagctgggattacaagcgtgcaccaccaccctggctaatttttgtatttttagtagagccagggtttcaccttgttggccgggctattctcaaactcctgacctcagatggtcctcacacctcagcctcccaaagtgctggaattacaggtgtgagccactgtgcccagcccacttgcaaaactttttaacatttataaggttttttacatacttgattttgttcagttcttagaataatctcatgatgtaggtgaccttattaactatttacaatgtgagaaaatggatagtcaatgaagataagtaacttgtccaaggtcacagcaccagaactccaaaccagaccttctgaccttcttgatacagactcctcacagtcacctgcatgccatctttggtttcagtgctatgaactttcttcactgcctgttggtctgtagctacacctactcatgaagatgcccagagccttagccgctccttgctctgccatgcttatcttatgcagctctgggaggggtgaagaggctgtggccagttacctcactaccactatagctattcaccaccctgttttctcctttagccattttagctactacacaattcttctgggcattttctgtcttagttccctagtatctggccttccctcttttctcagtaactgtgacccctgctagctagccttgccaaccaatggttaatgaaaggtcttggatatgactgtcaaagacaaaagcactcatgaccccaatgtttcaggtcacaatgattaggaaaatcaggacaacaaggcttgggcacagaaaagctggtttttgagagggggatttagagtttggtttaaatgtgtaatctttgaggtaatggtggaacagcctactagattcagttttctagtccctgaaaactaaaacgaggaataagttgaatcacatatttggggcaccagccaaatatatagcagcatttatagttagaatcaaagtgtttgtgtttcttaatttaaatgcttctcagagattccatttaaacaacttcattatgaaaatggagacttaccatgcctttttgatattgttcagagaaaattgtcataaataatacacacagtttgaaatggttgtacatcttatgaatcaaggggtggcatgtaaaaaggttcctcagtgcctcaatgtggaaaatatcatagaatgttattcttcaattgattccttccttgactttggtgtttatatggtatcttagatattttatgttattttaattatattttgtgtctttttatttggttaaaaatgcctacttaaatattaacagatttttaaatatccctttgaactcttccccattcctgtacctcctttccctttttccgttgtaatgtcagccacctgaacataacccagaaaactaggtatcatccaattgatgtttcagtggaaataagagaaagaagcacttactatttctcaatgcttaattgaggaaaagcacatgatatcttacatattttaaattggaggggataatagggtcaagttcatgcattatattgtggacatcttaatcctatcaaatggcttagtcaaaatgagaaagttaatgaatttaagcagacaagtacgaacagtgctctaaaaaaggtgctgttacaccatcccaacctgtacacacatgaaaaaaagctggggtgcattttgcgtttgaataagggtcatgttgactggccatggcagaccctgctagaccatacagctgatactctgtcacctgccaggactcaaaaggacatgggagtatgtggttaagttctctaaggactctttcttctaaagggaagcagttttataggtggtccttgtaggtctgttgattcacaatctcgtgctttcttgattggactgtattgttttactgtaattttttggacttacaagaagtcaggtgttttcatggactcttctcttttccatacagatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaactaatgagaccaaagccagtgctttcctaccttcagcagatacctttatttagcatcttttagatcatggtgtctggctcttaaatgtcccccagctctggtgcacatttaacattatgataaggaactgggatgttccagacaactatccctaacttccttttaagagtttcagggggcagagaaagagaaagaaaaaggaccaaatactttgactgcttaaagtatatatgtcagggccaggtgcggtggcgcacgcttgcaatcccagcattttggcaggccaaggcaggaggatcacttgaggctagaggtttgagaccagcctgggaaacatagcaagaccccatctctacaaaaaaacaagaataaaaataaaacaaaattagtcatgtgtggtggtgtgcacctgtagtcctaactacttgggaggctgaagtggaagaattgcttgagcccaggagtttgaggctgcagtgagctatgatcgcaccactgcactctagcctgggtgacagagtgagaccctgtctcaaaaaaaaaaatatgtacaccaggatggggaatcagagtttacttcactaaaagaaataagtacactgtcaccagaggaaaagttgctgatgttattgactatttgcttttagaaatctccctccctagacattcagggcactggcttttctggttttctgaaccctgttccttttgcttcttcattaccttgttcttatccattaaatgtttgtgctccctggagcactgttttgcgccctcttttgagccacatcacagctctccctagggaatttcactgtctgtattcgcctccactgccactgtcttcattagcttgctgatgaatctcaccatcattcccttagctccacccaaccctgacattcaggctcatgtttctagttatcctttgtatgttctccttggagatattctacaggtactttcagctcaccttgttgacagaaatacgtagcaaccatgtacatcccaaatacccacgctagaaactccctgtcccttgttctgacctcatttcaactcagtcacccaagccaacctctgagttgcctttcacctgtctattcctcccatttcctctgctaccctgtagttgaaggccatgttatctctcacctgggcttctgaagtagtttctgaatacgttttcttgcctttattctctccccatctcattcacccatgatattactacatctttgattataaatgcaaatattctaacaatctcacctgcttacaatgtctaatattttttcatcatccgcagaataaactgcaaactcttttacatgacttccatagctctctacagcctagactttacatctttttatagcctggcctccccacaagcatctaggcctagtcacaccaaattctccttatttcctgaaaatgttgtacttattattgcttccatacagttacacacccttttgcctggaatgcccttttctacaactggtgattgtccaatgttatttaaaactgtgtctcagtgaccctttcatgattcctttaggcaaatggtctctaagttttattagttttatgtatcacattttattgtaattttttttacacatatctcacctgaatagattgtgggtttttctaggtgggtctgagctttattcaaaagtgtttattaaattagatgagaaaaggaggaacattcttcattttttctcctgctttaagcactaaaccaagagttctataaatgcaataagcaaaaaagtgaaaaatgtactcagaagactatactggatcagttagtgtagaatactgttatattaatttttcattgtattagggttctctagagggatggaactaatggaatatatatgtatgtatatatattccaacccaaagtgtcttggtggcaatcttaatatatatatattggcaatctttatatatatataaaggagagtttgttaagtattaattcacatgatcacaaggtcccacaataggctgtctgcaggctgaggagcaaggagagccagtctgagttccaaaaccgaagaacttggggttcgatatttgagggcaggaaacatccagcacgggaaaaagatgtaggctgggaggctaggccagtctcgctttttcatgtttttctgcctgctttatatttgctgacagatgatcaaatggtgtccatccagattaagggtggatctgccttccccagcccactgactcaaatgttaatctcctttggcaacaccttcacagacacacccaagatcaatattttgtatccttcaattcaatcaagttgacacactcagttttaaccaccacaaatctaccccttgtcaacttgaacccgtacacatctcctgagatcacacataatcttcaaataaagacaataattaggtcataattacacctgatgtagtacaactattcttcatacatccggaaacacactagtccccaactgaaacactcttacataaagttaacgatacttaaatgctgatgtgaagtcaataaatcttatgtcacatgataaaggagaaaggaaataaaatgaagatattttcttagtacaagtgtgtgcaagcacagacatgtttttaataaaagaaggaggaaatactgaggacaattacagtcctcatttctgcagctggtcacatggtagtagctggtattgatgactaccttcttctacccattttgtattccttttgccttcagcaaacacctcagcaggttgtgtttttttttttcctgatggagaggcccaaaccatttgtagtcccgcctggattgggctgttgtagttgcccattgaccttaatcacagggcatggtaatactaagagacgccctaatggatctcctgtattccatgaatactctttcttacctccgttctggagtagtagactgatttcatcttgatagcctgggtcttgatagccttgatgtcccagccaacactgtaacgcctttcttagcctgtttacttaaaggtaggaacccaaagtgtcctggtggcaatcttaactaccagtttaatggaattgttgttgtgtcttctgatggcagcgttcctccctctggaactaagacctctaggccagcagaacttaatgttgcgggaacaggaagcaaacattttgctagtggatcactaggggtgatggtgagtggtaccacttccatttccaccccttgattcctggacctgtgaatcctggctatgggagaaacagtaccacatattggacgctgattcagagcatacacagccttcttgagaactttgccccaaccctgcaaagtattctcacctagttggcattgtaattgtgactgcaaaaggccattccaccgttctgcttcaggatgttggggaacatggtaagaccagtgaattccatgagcatgagcccactgctgcacttctttagccataaagtgaatgccttggtcagaggcaatgctgtgtggaataccatgacagtggataaggcattccatgagtccgcggatggtagtcttggcagaaccattgcatgcaggataggcaaacccatatccagagtaagtgtttattccagtaaggacaaacatctgcccttttcacaatggaagaagtccaacataatcaacctgccaccaagtagctggctgatcaccctgaggaatagtgccatatcaaaggcgcagtgttggtttctgctgctggcaaattgggcactctgcggtggcagtagccaggtcagctttccaccggcccatcttgttttctgcactgggaaggtggggcatgagcacaaatgttaggacctgaaaggtggtgaactctgcctgggcagggcaaagccagaggaaactctggtggaggtccgtagcagtcctgatgtgcaaatcggtcatccaacctgggtgtaggggcgaaagactaattgaaccatctagtagctggttccctccaaagtttccctcgggatagctggcactctcgcaaaaaccccactcttggtaccaatttactgtattagtccattttcacgctgctgataaagatatccccgagaccgggaagaaaagaggtttaattggacttacagttccatatggctggggaggcctcagaattatggtgggaggcaaaaggcacttctttcatggtggtggcaagagaaaattaggaagaagcaaaagcagaacccctgagaaacccatcagatctcatgagacttattcactctcatgagaatagcacaggaaagactggcccccatgatacagttaccccactgggtccctcccacaacacatgggaattctgggagatacaattcaagttgagatttgggtggggacactaccaaaccatatcattcatcaaaaggtgttggtggggtagagggtagttaggatgatccatgatctccatcatgatgatgatggtattgatgatgtaagtcactgaaaatatttggtgttataagaataatttcttcctgattgtcagttttgagttgttttgctattaggaggcaaagtaggggggcatatacccacttaaaatattttaattctggctagtggaaatgacagtaatgccttcttcataattaaaatgtcactctgaaatggtcccaaattaaaacttcttcctttgttgttaagaaggatctcttcttggtgtgttctgcaagattctgatcaccttttttttttttttttttttttttttttttgagatggagtattgctttgtcatccaggctggagtgcagggtgcaatctcggttcactgcaagctccacctcccgggttcacgccattcttctgcctcagcctcctgagtagctgggactacaggcacctaccgccatgcccggctaatttttgtatttttagtagagatgggctttcaccttgttagccagaatggtctggatcgcctgacctcatgatccacccgcctcggcctcccaaagtgctgggattacaggtgtgagccaccacacccggccgattctgatcatcttttatacatatgctatttttgtctatcactttaggaatcatcacagatcaaggtcatccttttggtttttgtgatagcgctatacctcagtcagcttactagctcatctccactcagagatgaagaagcataggcagcaagttagtgcctatacataatatatatggaaaccaaattcagggttgattctttctttctttctcccttcctttctttctttctttctctttctttctttctttctttctttctttctttctttctttctttctctctctttctctcttcctctctctttccctctctctttctgtctttcttctcactctgttgcttagtacagtggcgcagtctcggctcactgcaacctccacctcttgggttcgagtgattcttgtgcctcagcctcccaggtagctgggattacaggcatgcgctatgaagcccggctaatttttgtatttttagaaaagatggcgtttcaccgtgttggccaggctggtctcaaactcctaaccacaagtgatctgcccacctcagcctcccaaagtgctgggattacaggcatcagccaccacttccggcccggggatctttctgtttcagttgtgggcatcactctgaaaatcacacttgctagaagtgagcatttatatctcttctccactgtaaataagtgcctcttagtgacatgagtggaaagacaagaagaattgcagttccttcattttctgtcttagctccctgagatgtatatgctgtgcctaaatttgtgttatagttttctcctttgatttgacattccttgataggcagagagcacttttctgtgctcatatgtcacatctcgcatctttttcccttatagaaaaactcttgtgtctcccatttacctttctatgaggtcagagatttagatactttcctagacaatcaactggagtattaacaaattcaaggagttctcgccatcccattactgggtatatacccaaagaattataaatcgtgctgctataaagacacatgcacacgtatgtttattgcggcactattcacaatagcaaagacttggaaccaacccaaatgtccatcaatgatagactggattaagaaaatgtggcacatatacaccatggaatactattcagccataaaaaaggatgagttcatgtcctttgtagggacatggatgaagctggaaaccatcattctcagcaaactattgcaaggacaaaaaactaaacaccgcatgttctcactcataggtgggaattgaacaatgagaacacttggacacaggaaggggaacatcacaaaccggggcctgtcgtggggtggtgggacgggggagggatagcattaggagatgtacctaatgtaaatgacgagttaatgggtgcagcacaccaacatggcacatatatacatatgtaacaaacctgcatgttgtgcacgtgtaccctagaacttaaagtataataataataataataaaaattcaaggagttcttatctctgtagtttaaataataagcaacttagactaatgacaacaaaaagccagccatgtgaataccaaatttactagttctgtgaggatatttttttctctttctctttctgcctcaaagaatctgctttgcttcccctggcatcatgatttagttttcaacccgtcagagtcttcctgctagtgctggtactttcctacttgagaaagtccacggaataccttcgagacctctgtcctcctgatggcttctatttcatttgttatatagggacccagaggtccttcatcattttcaaacacatcaacagatatttatagcaaggccacaattaataaaatgtttcccagaatatatgtgtgtgttacatttagaggaaacagaagtagtattgacttgtttctatcaccagaggtctatttagtaactatattttgtggaaaatatcgatatattttatccattcaacagacatgatttgagagcataccacggagacccaaccctgccagtgtggcaggtggtataatagaagaaaatagcaaacttggtgtatctgtgtttgcgcacatgtatgtatgtgaggggcactaaggatgactttacagaggttggaacttttgagtagagttgccaagatagggagagttcactaggaaaacagaagggaagttgatttttttttttttttgaaatggagtcttgctgtgtcgcccaggctggagtgcagtggtacaatctcggctcactgcaacctccgcctcctgggttcaagtgattcttctgcctcagccttccaagtagctgggattacaggtgcgcgccaccatgcccagctaatttttgtatttttagtagagacagggtttcaccatattggccgggctggtcttgaactccttacctcatgatctgcctgcctcggccttccaaagtgctggaattacaggtgtgagccactgctcctggcccggaagttgatattcaaacaggagcagcatatgcaaagacagtgagctctgagagagtagatggatccagactcctattgctgatagcgtcctgcaggattgggcttcaatgtgactaacctacaattgcctccaggtgctccacccactgagtccttgtgtctctgctgaggtccttggagagttactggagagggctctgtgtcagatgaccttgaggaggctctgatttagccttttgtaaaatgcaaagagttgaggtcttctccacgcaagagctcgctgatgtcaatgaggtattgaggatggggccatctcctatttctgtggccagtactgagttttgttatccttcctttaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccaggtaaggagctccctagtgtcccaggattaggggacaaacccctagcacaggaggtagtgggtgtggctcaattgctttttttaggaagcgcaaggaaaaagggaagtgagaattttgtgtggggtgggttgctagtgagggaggagttttatgggcccactgtggtccataaactgagcaggggataatttagcatgtcagggtttatgatgatgagtggctagaaaattgtttattgtcccttttgtagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctcttttaataaagaatagataatgctatcattctagatactaaataagtattttcttaacataatattactatccactttatcttgtagaagaaataactaaaatacatctgtcttcactcctgtatttgtttgcattttaaggattaaagacagaaatagaaatgtaaacaactttattttgaaaatatttcaacactgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtgtgtgggaggggagattagcatgaggggtgggaatggggagattcgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtgtgtatggcgttgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcatatgtcccaggtggagttcagaaaatattctcttcatttccacaaaggggaatagtgcctggagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgttcattgtctgtcttttccaaattctactgcctcttaccctctccagaatgaaaactagtatctttgtttttgtttactgatgtaacccaaacacctacaaacagtgcccagtatatactaggcccacaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcctcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcacattctatggcttttgtgtctactctgttgttgctgagcttatgaactattagaaataactccctcttgcattttcacacatggggaatgtgatgttctcttgggtattatgctaatcatattttggcaggtttctctggagcagatgcagaaatgatcataccactttccagggtgtattattttagctcctttgacttgggccctaagtctgttttacctgatgttcctgaaagatgttcctgatgtccttcactgttctttcatgctggatgttcttgcctatgctgcctcctcagctatcaccctctcttcccctttttaatgtagaactcattcttaatgatttgtcaaaggcaccctatttcactgaaatgccttctatattccctaccctccaagtggattgtagaccttctaaggtcttttgacatctgcatatctctagcacagcacttatcacggtgattatttatctgttcatctttccaagtagacactctcattttaactccctaccctagtcgccagcatccccagcatagtgcctgtcataaaatggtgccacaatgaaaatttgaaaaatgaatgaacgtgataaacatagatgagaatcctatattctacaattttttaaatgtactgaaattattctttttgaatcctcctatttatttctgtgacttctttgatgacaaagttagaaaaaagtggaggtcagtagggagatatgaagggacgcaggtggaagcagtgagcctgggcgggtgatggagtgggagatacgtggcacaggggtcagtgagttaatctgggctcattcagagaatggaaggtgtgtgccaagaaaactggttggatagggataggtcagggattccctcttgcattctcacacttgggggcatgtgtcattttcttttcttttcttttttttttttttttttttgagacggagcatcgctctttctcccaggctggagtgcaatggtgctatctcggctcactgcaacctccacctcccgggttcaagctattctcatgtctcagccttccaagtagctgggactacaggtgcctgccaccatgctcagctaatttttgtatttttagtagagatggggtttcaccatgttggtcacgttggcctcgaactcctgatctcaggtgatccacctgcctcggcttctcaaagtgctgggattccaggcatgagccaccatgcctggccgcatgtgtcattttcttgggtgttatactgatcgtatatttgcaggtttgcttttgtgacagacttcttctgggggaaaaaaagtatccttctatctttttacttttgtccagttccaggtatccctgtttttttcttcactcttccttccttgttcatgggagtttttcttgaggacttcaagcccagcttcggagaatcctggttgtgtcatctcatctcctttctgctctcttctctacctagcctttccaccctcacacctcccggggtctgaaaatggaaagataagggtgtttccctgaaagttgctcttctgtgtggggatgacaggttctaaagactcttttctggtccctgccctcattgccatgattaatcagttaagtggcccgaggttttataacagcacagtcttaaaatgcttctcccaagtttaatttctctccatttgaccttttaaggatgtgaattggctttaagcagtagactccctttagtacggtgctgtgagcctctcagtgaatctgctacatccattccacccacgggtctggaaacttgtctgtttacctttccctaaaaacctaagatatatttttaagaagtgccttgtaacttttcatatagcctttcccctactttgggtagactgtttcttacaggaatttggtagatctttccaaagagaattctgtatctgtatttttaaagcataaatcctgtcaactttggaggagaactgatttggcttgagttttctcagacatgggaacttttgacctaagtttgtattttacattgttgaaagggaactccgggatcccagaaaacatatggactgcaattgggtaaagtttctgttccagaaatgcctcttctggacatttcatacaaatggaaacatgcagcatgtagtaatttatgacagcttctttcacttagcatgaggttttcaaagttcattgatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtataattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttctccacatcctcatcaacagttgttattgtctgtcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagtttttaaaaaatatatcctaaatacaagtctcttatcagataatatgatttgcagatattttctgtcattctatgtactgtcttttcacattcttgatgatatacttttcagcccaaatgtttttaacttgatggaatacaatttattttttcttttgttgcttgtgctttcagtcatatttgtgaaaactttgcttatcccacattacaaagatttactatttctaagtgatttataattttaccacctacctttaggtctctgatccattttgagttaatttttatgtgcgaggagggagtctaacttgattcttttacatgtggatatttagttgtcccaggaccatttgttgaattaagtgcccagaacaagtacatctatatatagagaaagtagattagtggttgtcagagactgtaagaagtggggaattggagagtgactgcccataggtacaggcatgctttttggcattatgaaaatattctggaattaggtagtggtgatggttgcagaacttttggaatatggtaaaagacactgaaatatatgcttaaaaatggtgatttttgtgatatatgaattatactatagaactaataataacagtaataaagcaaggtgtctttccacatctccatgccttgtattttcattaaaaaaaaaaaaaaaaaagcatttcagggccaggctcagtggtttactcttgtaatcccagcacttttggaggcctaggtgggaggatcacttgaggccagaagttcaaaaccagcctgagcaacatagcaagaccttgtctccatgaaaaataaaaaattagccagaaatggtgatgtgtgcctagagttccaactacttggaaagctgaggcaagaggatcgcttgagcctaggagttcaaggttgcagtgatctataatcaccactgcactccagcctgggtgacagaacaagaccctgtctcaaaaaaaaaaaaaaaaaaaaaaaaaaggcatctcactttaatagtaagaggccagaatatgatgctggcagcatgttgtgaggaaatgtattagatgaaagaagttaaattccagttctccttttttcagaaatgaggtataggggagagaaacacgtactttgaaagaattgacccagctgaattggaaaatgtgggaaggggatggggaagaggctgctccacctgagatctggctccaggacttacagcaaggggaacttgggcaagttacagactgtctatgcctcagtttctttatcagcaaaacagaatcatcccataaactataaggtcgatggtatcagcgggtccccaaactgactgcacatctgagtcatgttaacaaacacattccaggccccacctgagccctctgaatcagaatccctgtaaggaggatgatgaacttgaatttgcactgactttcccagctgtttcttactctgatcaacttgggggtaggacccattgagctgcatcacatcattccaaagccaaaacacaacagcaggacaagaatattttcaaggcagtctctaaagcagaggagaaactgttgagggaacttagaagtaaaggagatctggcttgctgggctccatttgaactttgagtacaacagagacatgagcccttcgggacacatgcctgaggtagtgacaatccaactttggaagagtggaagccctagtttcaaattcaagcatgctttgagtataaattaagtttacctctttttgcacagcaacatggccaatctttcctaagctgctcagcttacaagaaaaggaatcatactgctaagaattcaaacttcagcagtcataggtaagtaaggaagtcttataaacctattctagccacctaaccagaaactcgaaatttagcaggttctttcagtttcaggacagttgtgttcactagatcagaggcattgagacatgaagaacagacccttaaaaagggaaagtgttcccttcagtttgaggacatcactggaacattagggaagtgggaacacagctgctcactctacagtgtgggttgcctttgtgtctggaatgtgtctgacgtcctgatccctgtgcacatttcagggagccttgggaggaccccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtaaaatcttctccataagacatacattgtggttataaaaaggcaaaagtcttagtgagaatcattggtattccatagaagagtgaattaaacacagccaagggaagacccacgtctcatacttctcttgtatattccaaagttccagggaaattccaggtgatagaggttatttcccatactgttaaagcaaggtttcagacacttctgaattttggtcccagtactctagaagggcacacctctgtcctggaaaataatacaggaatgaatactcttcccgtgacccattctggtcattcttccagcatcacaaaaaccaaaaaatggaaatatggccaaatacgtgattagctgtccctcatcttcaggtttcttatctgttacttatagataatagcattaccttaaggattatgatgaagatacaatgtccaaatataaacacagttttgagcaaaatgccttgtacgaattggtcaatgaataattactaaatatgtgaatatttctggattgtatggatcctatgaataattactgaataattattgtgattgcttttattggcagtgctgaaaactcatccctttgtgacctcaagtaa

SEQ ID NO: 673 - DNA, 16112 bp, Homo sapiens
gtctgttaaacaacagaaagagtgacctttggtgagtgtctggcacaattttctacactgcctggctccagattcaccaccgtggcagagccaactcctcagtgtaagccccaaggcccccgcacttggctcaccacctggcgagtggcagcgccatggtgacctcagagtcttcccatgatgaatggttcccactcagtcaaaggcacttacaacctgcctcaaacacatgaacactgattgaatccttgttttaaaaaattaggataggccaggcacgatggctcatgcctgtaatcccagcactttgggaggcttgagttcaggagttcgagaccagcctgggcaacatggtgaaactccgtctctaccaaaaatataaaaaattagctgggcgttgtggcatgcgcctgtagttccaactactcaggaggctgaggtgggaggataacttgagctaacttgagcctgggaggtagcggttgcagtgagttgagatcgcgccactgcactccagcctgggtgacagagtgagaccccatctcaaaaaaaaaaaaaaggagataccctttatcaagttaggaaagatccccttctttatatttaaaagaaaaaaaggctgggtgtggtggctcacacctataatcccagcactttgggaggccaaggtgggtggatcacctgaggtcacgagttcgagaccagcctgggcaacacagtgaaaccccgtctctactaaaaatacaaacattagctgggcatggtggcgggcacctgtaattccagctagtcgggaggtggaagaatcgattgaacctgggaggcagaggttgcagtgagctgagatcgtgccattgcactccagcctgggcaacaaagagagactccgactcaaacaaaaaaaaattaggataactgaggaaatctgaatatgagctggatgttagaaaataatccatggggctgggcacggtggctcacatctgtcatctcagcactttgggaggccggtgcaagtggatcacctgaggtcaggagttcgagaccagcctggccaacatggtgaaatcccgtctctactaataatacaaaaattagccaggcatgcatgcctgtaatcccggctacttgggaggctaaggcaggagaatggcttgaacccgggaggcagaggttgcagtgagccgagattgcaccattgcactccagcctgggtgacaagagcgaaactctgtctccaaaaaagaaaagaaaaaaagaaaactatctgtggaatattggccaatagctcaatcttaggaggtgctgaagtgtttatgggtgtctacaatatcttacattcaaatagttcagaaaacattacataaatatgtatacacacaccccataaacaggatgttggggctcagaaaccaatatcctaagatatggcatttggacatgctgagctgaagaagcctcgtggtctctctggccctccccacggccaccgtctcttccaaagcctttgtctgcctaagatccagatccaccaaagggaacaatggtttttttcttcccctttcttaagaccgagaatgagcccccacctgaacagaccctctcccaggataatgtacaagttcatttctgatccctgccccgttcattctccctagtaatcctctcaccagaactgctgttctccccctcccataacctgctttgccaggatgatatataagcttccgaaccacagtgtggggtgagcagttcctctgtgattctccccatgtacgcgtttgtgataaatgtgtacgccttttctctaattaatcagcctttcttgagttgatttttaagtgaaccttcatagggccaagcccttggcccctacaagagcaaatatggcaaaatattagcaattgttgtatctgggggatattgatagatatttatcacacttttctgcatgtttatgcatattcaagtttaaaagttgggaaagctctacctcaaaactcacttgtgcaggaagccttcctgattcactctacctgatggcctgcgttgttcctcgggacccctgcctgcagtccctattctgctcatttctgctgctgtgtctttcttcacccacgagcctgggcatcgaggccttgcacagtggcgtgtgcggggagggcctagggcctggagactgaggcgcagggctgagttctcatccactcactcgctcagcagacacaggaggagtgtgtgacctgcctgtcgctgtgctaggtgctgggactccctcaaggagtgtacactcaagagaggggggaaaacaagcagacaagcaattgcgatgccaccaaaggcacagctctcctgagtggaaagggactcctgggcctcggctgtgtaagcagtgcagggtgtgcccaggaagtgcctgcccctgttctctgcataaccgctactgctcattaaccagcgaggccttggtttctgcatttataaaatggtgttcagacaccagctcagcccactccacagggcttctctgagactcgggcaggagacaatatgtgaaaacattcagtaaactatacaaatcctgtgcagtgatcaggggttgtaattcttatgagacacaatcaggtggctaaaaagttcacctggaggccgggagcggtggctcacgactataatcccagcactttgggaggccaaggcaggcagatcacttgaggccaggaatttgagaccagcctggccaatatggtgaaaccccatctctactaaaaatacaaaaattagccaggtgtggttgcagatgcctgtaatcccagctactcaggaggctgaggcatgagaattgcttgaacccgggaggtggaggctgcagtgagccaagatggtgccactgcactccagcctaggcgacagaacaagactctgtcaaaaaaaaaaaaaaaaacccacctggaaagaggtcttgaaggctctatagagaggagacagatgaccaaatgcaatgatgacacaaaacaagaagaaaagaaatgaaagccagctaggaacatgggctgggccctgcttgttaagacccctatccatcttggggtccttagtaagaatctttgggctgcgtttccctcttttgtctgggagccggggtggggacagagttgctgctgtccattgacacatacatgccttccgttccctctccccatattccctccgtggagtctggggcctggggtccagtaccatccccactctcacccccactcaccacctccactgcttttgacctcagatgcatgctgggtggcctggctgcacccccactccgcctctacttgatcaccagctcaggtggagcaggctgggcttggggagacagtgcagccttcagcagataaaacctgaattcagttcctacgcccttcccctcccgtgtatgctgcctttgtccaagtcaccttcatggccccaagcctcagtttccccaatctataagggaataataaaggtacctatttcaagttactgtgaaaatcaaatgagattatgtctttgtaaatgttttatttttataaactaacaataagctgattcacctagatcagtggctaccattgtcgcttagtacagattcttacccttgggtcctagggaaaattcagggatttatgaacttgggtggggaaaaaagtcatctttatttccactaacctttaactgaaatgtggtatttctttagttatgaatgagggtcatagaccacagtaatatcagtagccccatggctttatctccagcagaaaccacagatttttcacaaaatgctttaaagttgttattcttgaattatctggtatgctcatcactactatgaaattgtggcatttattagacttgctactaggttttattatttcacatgttgatagggaagcacacatattattatatcataaatcattttttctttcttttttttttttttgatagctgcatttcaatagagcttgtttcctttgtaccccagtgaatttacttttatgcatttagaagcatttttctaggaacgtgtccacaggcttcacagactcccaaagggggcacaaaaataaaggatcccctggcttggtgcaagcttgaccccaactttgttcctggccttccccagccctggcttctggtcaccgtgttgggagagctgagcctccctgtttcaagagaaggcccaggtggtgaggcctcaggtttacagagcagagtggatgatggggaagccctcgcacgttctgtctctgccttttggtgtcactcacccacgcccgttatcttccattctctgatcttctctttcctctttcctttctccttcattaccccttccacccccacactctcagagccttcctttcagcctatttttgaacatccctgaggataatgtcttttctgtggctcctgggaggcgccactaccagctgtggctcgttagctgtgctggaaaaactctcgcgttgtgcctcaagggcaagaggagtctctggttccacttggcactcagagggggaccagggatgtctcaatggtgggaacaatggggagtgtgaccttggagctggaagcagggctctgaccccctgcaggagggatgagagtgccctcacctctagtgagaactgaggccctgcgccggccccagccaaacagtgagggcgtgcagaccttgcccaggaaggccaatttctcagtgcaaagggagccatggccagggaacccggcccgggtcctccacctctgaagctgagctaggcatctgcaggccagggtgaggggctgccctgtgtgacccgccggacccaggcatagagcagcacctgagtcaggctgtcccagagcactggcagcttcactgcaggggcaggctggctctgctgacgccagacgctcagtctgggcagagacttctcagtgggggcagagagtaggtgcttctctggctaatctgcctcccagctctgtgtttgataaggcccaagtccaactttacagattgcaaattgaccttatttctctttggcatcacagaaaaacaacctataatccaccaagccagatatgagcgggcctgacctgtggatcctctgcccacctgacagacatctgctcatttgtcgggaacccctcaagagacaactcctccctgcagccggcccctcacttccccccacccatggagcactgatcccagccaccagggcctgacacaagggcccatcaccatggcatctagcaaacacgtttctcacgctttgggttgtatttatctcttccccacctagctatgaattctgcaagggcgagaggaatgtgggttgaatctgctgcacatggtagcacttgataagcggttcctgaatgaatgagtgaatggcagccagtccttcccattctgaggcagaggtgcagccaggagagggcgtgtacacaggtctgactgaccacagtgggaggggactgaccctcatcccttggtcgcagctggactttccttctaggcccgatctccctggcgccccaccctgcacccatctgcctgggcccactctcctgggcatgttatcagggatgcacagactgctccatgttcgaggggactgaggcacatccatcaccctcgtgccctgggtgctgctgcatccccagagcctgactctgtgccttggacttagtagatgctcgaatcacagttcgcaaacccatgcaagagtctctgatttgggtttcgctttccttccccctgcctgtgtccactctataaaggcagaaaggaacctgctggagctgggtcctccccgagaggcttgcagttccagaacaggcaaaaacaatggcttcccacaggtttacaaaacaaggagcaggctatagccccgaggaagctgcaggaccctcatcggttccaactcctgtggaactgatgaggactaaaggggccttcctgtggccatctgggtcccggaggtgggcggctttctaggctccccagcctgccacaccccttgaggccaccccacccagcttcaagcctcagccctaacttccaaaggtgcagctgtgccagggtgcgggtggggaagacactgtctcctggggagacctccatcttacctctgaggtcagcctctgctcaggtgcagcgtcacagcagggggcctgcgttctgcttcccagtctgggagaagagagtgtctggatattttcaggaaaaaaaaagaaagttgagcagccacagcagggcagggcagtctacatcctcaagtctccctcagcttctctgctgctgccggctggcctcaaattttgcctctctttggttctctgagaagttttaccaagagaagagacaggaggagagatccagcctggactattgtttgtggggtgtgtaggtgtgtgtgtgtgtgtgtgtgtgtgtgtgtgtgtgtgtgtgtgtatgcgtgtatgtatcccgcgaggctggagccacagcttccctgatgaaccatggaggcgggccagctcctgagctgcggttgccctggagacccacctaagcctctttgcctggagcagcattatctgtagagggagtggctgatctgacacaaaagcctgaggcgacccaggcccaggcagtgagggagcacttgtgtccagatggcattctgtccgcttcctcctccagccggtgctcagtgtggcacaaactgggcaagaccattctcacccaaccctctgctgagccctaggtgtacctgctgttggcaaatgtttccagctgcctggtgggtggctcctggatggagatcccctctttctatcagctccctcctacagggaaggggtgattctgggtgctgaggacagggacctgtgaagatacatctccgcctttgccccaccacatcccttgcctgtcttcctctctgcttatctaaattatttccttccctcaaggcaagctcaagagcagacagttctgactttcagaaggaggggctgtccagggagaagaggaacatggaacagaaagcattgacgttgaggtatttgagataacatttggggatagcagaagcatcctgttgctgttctgcagcatcccacactcatgtctgggcctccttcctgtctctgctctctggtcacgctgtcacttgtagactgttctgcctagaagccatgtgtgggccagcttgcacctaacagacattaggtagcactaaaacagatgcacactgccctgtgaggggcatgggaatactgtaatgggcatgaagctgcattataatagatcttaggtaatcctgtgctgggtgatagcgtgacttttgcacacatctggttttgattgtgttggaaataaagcagaaagtacaaccaagaataaattaaacaatggctgatgaaatggactcaggttgcccacctgcctgcctgcatgatttcgtccctgggtgatttgtcacttcgtgcttgctctgtggctggttccactcagctggttccatccgccttccctcttcatccatcaagcaggcaagattcttgagtcaggagttggatcatatacttctcttgaccagttcacagcacgacagccccaaagattgagtgggtcacttggggatggaagatccccacatttgagggagctgaagctgacttcctctgacccacagttcccaggcggcctccacctcagggccagctaaggccagagtcacccaaagcaggtaactgggagtccccacctctgagcaccccaccactatcctggcactttcccaaggggcgtggcttggaggtccaagggcagaaattcccaggcatttccacactgtagggaagggagcagggggatgacaagactttaccttccctttaggaaagttgctggaggcaatgaggagaggagggcatggactaagtcacatgctcatctgtgcagcacgtatttctaaagcaccattctacaggggcaccaagctaggagctggctgagcctggctctcctctctgcacacatcccagccaagcctgtgtgtgctggattgctggatcagatgaggaggaggtggaagtctggcaggcaggtggggagcagggacagcattagggcccagagttaaagacttttatctccaagtagtacaaccttgggtctgctactgaccattctgtgtttgaataaaaacaattcatcccttttctatagccatgcttttgtattaatatctccccttctaatgcacacacaatgaatgtaaatgagatcatagaggccaatgtcttgagccatcagaaagattttgtcgcagcagctgccagatgagcttcaggactcctgaccctgggatgccagggaacaagcacacagacgacttatagcagtctccctggcagacgcagctggcccctctcctgcatttttcaaatggtgcctgtgattagaagagggaggcactccctaacccacgaccctccctgacagctgccttgataccgtaactcacaggccttggtgggtgtgttgactcctcatttattctgatttgttcacctgtggaggatttgtgattatccttgctgagtgtgaatttgctctggggagaaaaggtggcggttgtttttctcttgtttggcgtggatggaagttgctgaagcatagatattcagcaaccatcaaatgcagaaacaccggtggggcccgcaacattgcctcatagatggcatttgattaataaattggaaatgtggagttatgaggcgattacatgcaaggctggattaaaatccgcatggagattagagataagccccggctctgcgtgtgtgtgtgtgtgtgtgtgtgtgtgtgtgcacgcgcgcgctccgttctctcctccctggagtctttccaggctatttcaaaccatttctaaccactcagtcatgcgttgggttttccaaatcctgcagaaggtctgtgtagccctaatcccaaagaagttgaattaaatggacagaatattcataggtacagaccagatttgcagttacttagacctcttctctctgggcatccctctttctattcctgtggtcacatttcctctccaggtgctacggactgaatgttgtgtcctccccaaaattcaatcttgaatctcccaaggtgatggttaggaggtgggacctttcggatgtgattaggtcgtaagaggggagccctcaggaatgagattactgcccttgtgaaatggtctcagggagctttttggcccttctaccacgtgaggacactgtgagaagatgcctccatcaactaggaagtgggctttcagcagacactgaatctactggcaccttgatcttggacttcccagcctccagagctgtgagaaataaatttctgtcatttataagtcaccagtttatggtattctgtaatagaagcctgaatggactcagacatcaggtacaggaagcaatgtgtctgacggcaggaaaaatgagaatgctcccttccctgccagctagctgggaatgaggcataaagcacttctcattcattcattcattcaccaagcatttattggctatatactctgtctagactgcaccttgacactccatttccatagacttcactgaccacagcttcttcttcttcttttttttttttttgagacagagttttgctcttgttgcccaggctggagtgcaatggtgcgatcttggctcaccacaatctccacttcccaggttcaagcaattctcctgcctcagcctcccgagtagctgggagtataggcatgtaccactacgcctggctaattttgtatttttagtagagatggggtttctccatgttgaggctggtctcgaactcctgacctcaggtgatccacccgcctcagcttcccaaagtgctgggattacaggggtgagccgctgcgcccggctacagcttttcagttctgccctgtagtctgatggactaatgtgagggcctgtggcagaaacagctagctgtccaccaagagtcacatttctcctccagagtacatgaacatgtagtagacatgttcctaggaagcagctgtccagctggggacttcattccccatccctcctcccatctaggtggggccgtgtgatgatagggtgtagatggaagggacatgagtcacttcaaggtgtggcaggtagacacccctgtgcaactgtccaccttccacctttcccctttgctgatcgtcagccaggactctgaggccctcggggtgggggagacacagttttgaaggcgtttaggtccctcaatcacttcatgaaaagctgctcacccatcattcatgttgaactctaatgtgtgcaaaaaatcatatgcttgttgggtcaaagcactgagttggggtttctctgtaatagcagttggcaccacccagctcacaaaaaaccctgtgaaaaggggtgggtgtggaagtgctgccctttcctaggttcctggacatcagggctcttcctgacatgttcgccgctggttttttcaccatcaccttaaagacattacttcatcccctgttgtctcatgcccctgtgcatggtgcccactctacccagagtcccctcctacctggggaagttaacttacccctcaaagtttagcttcatggtaaccgctttgtgaattatcctctgtctgctgctccctcctctccactctgaagcctcattctttttttttttttttttttcttttgagatggagttttgctcttgttgcccaggctggagtgcaatgacacgatcttggctcactgcaacctctgcctcctgggttcaagcaattctcctgcctcagcctcccaagtagctgggattacaggcgtgtgccaccacacccagctaatttttgtatttttagtagagccaaggtttcaccatgttggccaaactggtctcgaactcctgacctcaggtgatccacccaccttggcgtcccaaagtgctgggattacaggtgtgagccactgtgcccggcctgaagcctcattcttccttctgtacacacagttgatcctcattacctaccaaagtactggcaaatttgcctactcactaaaatttatttgtaatccaaaagtcaatactcatagaactttttttttttttgatgcagagtcttgttctgttgcccaggctggatggagtgcagtgctgtgctctcagctcactgcaacctctgcctcccaggttcaagcgattctcccacctcagcctcccaagtagctggaattacaggcttgtgccaccacacccggctacttttttttttttttttttttttgagatgaagtctcgctctgtcgcccaggctggagtgcagtggcgagatctcggctcactgcaagctccacttcccaggttcatgccattctcctgcctcagcctcccaagtagctgggactacaggcacccgccactacacccagctaatttttttgtatttttttagtagagatggggtttcaccatattagccaggatggtatcaatctcctgaccttgtgatccgcctgccttggccttccaaagtgctgggattacaggcgtgagccaccacacccagactaatttttgtgttttttagtagagacaggatttcaccgtgttagccaggatggtatcaatctcctgacctggtgatccgcccgcctaggccttccaaagtgctggaattacaggcgtgtgccaccatgcccggcctaatttttgtgttttttagtggagacagggtttcactgtgttggccacgctggtctcgaactcctgagctcaagtgatcccctgcctcagcctcccaaagtgctgagattacaggtgtgagccactgcacctggcctactcatagtattagattgctgtaagagtaattgcggtttttcccattaaaagtaattacttttgcgccaacctaatacttttgtggtcattctagacatgtagaaaaatgttagtgacctgatggacttgttccctgctgagcttgaacaaggcacgctctgccttcttgtttcagctctcatgatcttaagtgtccttttcacagtctatttagtgcccacttttcatactttgtgctttttatttgtgattttgatatcgaaaatggccccaaaagtagtgctgaagggccttctagtgttcctaagtgcaaggaggcagtgacacgctttactacatgagttagatcagcttccttcaggcctgacttagcactgctggcggtgagttcagtgctaatgaatcaacaatatagagtaaataaggtgtctttcaatagaaatgcacataaaacaaggttatgtattggtcagctgacaaaaatgtcatgaccagaggcttcaggaacctcatccaggacgaggactgaacttcaccctgtatttcccctaggagcaatggttcagtgtttgctaattcacaactttatagataataactactgtgaataacaagaattggctgtgcttcacaccatttcctgagcatttaatcagcatccctgcagaagaagagctccccaaggtcaaggagatcaagccccagcacacggtaaaagctaagttcgtgtttgctgtacccacagagaacgcattagccagagtgactgggcttggtctctgtgttaaacaaatgccgtggacttgctccccactctcctgaacctgaaagagccccaagagacgtaatgtcacaggctcaaggaccacagacaacagatgtaaggaaggcaggaatggactgtggggtgccgaggtcacccagaagtccaaggatgcacattccaggggaggtgaggaggacatgtcactattagagggcggtggagagcctgggtattctccatccagctccaagcagtggaggcataagacagtcagaacctcccttctgctcaacctggaagtgcttctggaacaaggtagaataatgggaaatcaatgggaagagggagtcagccatgcggtgttgcattagagccaagaaaacctgaagtggcacaagctgcactgggcccttttgggagggctgatgaggctgtagaggggatgtgctggggcctgggaaggaaagagatgctattcgtggataatgtggtagaaggagtgactctgtggaattaaacacacacatggctcaggtgaacctggatgtcacatgtggatcttaacagattctcacatcagttcccaaagaagaaggctggtgagtccagagcaatgaagcagcctggcagagtccatctcctggctaccagaagccacctggacttggtgtggagaatgaaggagagaggggaattatcaggaaattctgactctggcagctgagttgatggcagtgagaagtggcgtccaggactgggactgagccccacggtggtgagacatggcgtccaggaggaggactgagccaatggtgatgagacatggcgtccaggaggaggactaagcccatggcagtgagacacagcgtccaggaggaagactgagccagtggtggtgagacgtggtgtccaggaggaggactgaacccatggcagtgagatactgcgtccaggagaagtagattggaggggaagcagagtgtgtctttggcttggtggaggtggaggaggagacttcatggctccagggaggagaggctcctggaccagctccatatgcagaagaaagggtttggctaaagcacacacctggaggccatcgaggtggtgttccgatccctgggccctggccaaattccagactctgttaaacaaggagcatgtgagcatttaagaaaggatgtggagatcatgtggcattagcagatgttcactgtcaacaggtcaggggaagccacccccaaagatgccatgagaaagcatggccagggacagttgcaatgcctctgtgccctcatcacatcccctcatccctcctctgcctacagggcagctctggcaggccgttctgtttgagatcaggggttcctgtaattgatagcatcccagctcaagctcacagccaccttttcactctctgccctctgaggccagggaagcccactgggcccatgtgcaagtgtggtcctgaagtgtaagtggttcatgtcaccaggacaatcttcatttgggagacaggaaccagaagatacatactccacactcctgtccaccacatggacagttctggaaggctgccgttacagttcttgagaggtgccacacaatcagacactgtggctgtgttgctcccatcagtgaccttgataacacaccctatgatgactttcctccttcctgtctcactctccttgcactctcgtttctgcttcctggactgcctcccaagtcctggaagctatacccaagtccttgttccagcatctgcttctgggaaaagcagagaggaaatatgaagaatatagggagccaagcaccgtggctcatgcctgtaatcctggcactttgagaggccaaggtgggcagatcacctgaggtcaggagtttgagaccagcctggcaaacatggtgaaaccccatccctacaaaaaatacaaagatcagctgggtgttgcagtgcacacctgtaatcccagctactccgggaggctgaggcaggagaatcatttgaacccaggaagtggaggaagttgcagtgagccgagatagcatcactgctcactgcaatctaacttgggcaacagagcaagactgtcaaaaaaaaaaaaaaaaagaatacagagtgatctgcgatgttaaatgccaagaggtccagtagaatgatggcccaggaaggggcatttgcaacagggaagggggtgcaggttactggagacactgccactggagctcggaagtgggcccagtactcccagggctaccctactgaggacatagagtctgctcttgcttgtgtgattctttacacaagtgcagcacctccatcattctccagggagtattcctaaaccagaaggtgctgaaagctttagagaagagctgaacagagaggtgttcactgcacctgcacagcatggtaaactccagcaattacccttggacgctgactctctccacagtctctccctccagccatcaccaggttccccctttactgacaccccttccctgtggctcctgcccccctactcctggatctcccttctccacacagccagcgacctctctcagcagccacctctctgagggctgggctcggatgtgaatgatgttgagacgtgagccacagcggtgaggcccaaggtcctcagttcccctgtcctctatggggttcccacatcagtaacctgcttcctcccacagcgcctttctatagagaagacaggccagggacaagagtctggttgctctaacgtgatccttccccagaagtcagaggggagaccttgctgctggcacgaggaggactgaacaattctttgtggaagcttttcccccagcgtgttctctgatagacccataagcagctggaatcctaccccctaggaactctgagtgctctgtttttcattcaccacatccagcctccctgcacactagccccatattcatttcctcaacaaaggtttactaggcatgtacttagtgccagccccagggcctggcaccaagggtggagctggagagggaaggcccacctgtgactgcatggggctcccagccagaggaggaggacaggctgtgtgcagtagggctgggagctgtgcagaaacccagagatgcccctggaaggtggcccctgcctcctggctcccactccctcaccatacaccccgttctttcatccctgggtgctctactaagaatcctgaaacagtagagcaatggggagcttcgataccctttactcccacacctgctgagatcacggactcagaagaggctagcaacttgctcatttagcacagcaagtgagtaacaaagccaggacaatagcctatgttctttttgttccaaaccattgccctgcccactgctgaccttgtggcatcagcaaatcagatagaagcctctgggccca

SEQ ID NO: 674 - DNA, 17907 bp, Homo sapiens
ccctggagtgtttgtatttttaaaagtctatgggttagattgatgcttagcaccaaaagagtgaatggtgtagccactgaagagcactgcgagcatgcggagtcactgttcctgcaagggctactgaatgtgctgggctactgcacagctccatgcctttgtcatgttcctccctctgcctgaaatgcccgcccattctacatggagaccaggtctagggtcagcaccctcggaagcttttcttgaccttcccatctccgaggtagatgtggccactctctaccttgtcccctgactgcactctgcacaggtgcttttcagagctcaggagcactttacggaacgtgactgcctacctcccctgaccccgggtgtggtatgtggtcagggcctgtgccttattcacctttccatccctggggctggacatgtagtcagtaggcacttaataaatagcaaacaaatgaatgaatgaatgcccgaacaaaggaacgaataaatgatggagaagctataacagttggatcaaggaacaagccccacagacctgacctgacctgatcctgaacaagaaggcattttccaaagctccttagggagcttttttttcttcttaatctgggtttgaatttgagctgaaagaagagagcaagagagtggcttggcagcagagggttctcctgtggccgggagaaatgtgagagaagaaatggaagacactgaagaaaacttttgcctccagggcaaattgactgcagaatatccatgccacagccacataagctaacaaactattaaataaagtatgttccgtttcctcccttgtgaactataccttcctaacaacatggagggtgagattcagacagcattcttggactcctcagagttcttctctgacacatggaggtgggttgggactgctctcggccctcagcctgcctccctctcttcccacctccgcttcatcccacatggtaaggggccttgcaaacacgtgtggggacaccccagctttcacctccaaggcccagccacacccctgcaaccagccacctctgtgccaccctctgacttagggttgctcgctggcagtgctgtctgccctgctcagtggccccttctgtggggaagtgggcgggcgactgtctggcagggaattctgatttcagtccctaagcctgacctcgaagggaagtgcccacagggtggcatgtctcctggacccccagacacttcacctcaaggcagagtaaggccagaagcaagcccgagtacagtctggggtgcagcctgtatggggtcctgcttccctgggcttaaggctcccgacctgagctggccgctagagaaggtgctttgtgacccacctcccccatctccagatggcaggggctgagtggagtgatcccacctgagtcctgaattttgtgggctctaagcctctttggcccaggtgtagggtctcaacaggggaggagggtgttctgagtcatctcctccccatcccctcacttcccgcaactctggccaggactggaggctttggcagaaacaagatttctgctggtgctatttctgtccccagtgccagctgctcccccagaaggctcttcagtgggtccgattaagttcttaagggcaaaggagggagggagagacagagggaggaagaacagagacagagaggcaggagggcaggctagacagactccagagggggctgccttatcccagggtatccccagaacctgaacctcggctgagactgggaaggacgtggtgcctgggggaggtctgttaaacaacagaaagagtgacctttggtgagtgtctggcacaattttctacactgcctggctccagattcaccaccgtggcagagccaactcctcagtgtaagccccaaggcccccgcacttggctcaccacctggcgagtggcagcgccatggtgacctcagagtcttcccatgatgaatggttcccactcagtcaaaggcacttacaacctgcctcaaacacatgaacactgattgaatccttgttttaaaaaattaggataggccaggcacgatggctcatgcctgtaatcccagcactttgggaggcttgagttcaggagttcgagaccagcctgggcaacatggtgaaactccgtctctaccaaaaatataaaaaattagctgggcgttgtggcatgcgcctgtagttccaactactcaggaggctgaggtgggaggataacttgagctaacttgagcctgggaggtagcggttgcagtgagttgagatcgcgccactgcactccagcctgggtgacagagtgagaccccatctcaaaaaaaaaaaaaaggagataccctttatcaagttaggaaagatccccttctttatatttaaaagaaaaaaaggctgggtgtggtggctcacacctataatcccagcactttgggaggccaaggtgggtggatcacctgaggtcacgagttcgagaccagcctgggcaacacagtgaaaccccgtctctactaaaaatacaaacattagctgggcatggtggcgggcacctgtaattccagctagtcgggaggtggaagaatcgattgaacctgggaggcagaggttgcagtgagctgagatcgtgccattgcactccagcctgggcaacaaagagagactccgactcaaacaaaaaaaaattaggataactgaggaaatctgaatatgagctggatgttagaaaataatccatggggctgggcacggtggctcacatctgtcatctcagcactttgggaggccggtgcaagtggatcacctgaggtcaggagttcgagaccagcctggccaacatggtgaaatcccgtctctactaataatacaaaaattagccaggcatgcatgcctgtaatcccggctacttgggaggctaaggcaggagaatggcttgaacccgggaggcagaggttgcagtgagccgagattgcaccattgcactccagcctgggtgacaagagcgaaactctgtctccaaaaaagaaaagaaaaaaagaaaactatctgtggaatattggccaatagctcaatcttaggaggtgctgaagtgtttatgggtgtctacaatatcttacattcaaatagttcagaaaacattacataaatatgtatacacacaccccataaacaggatgttggggctcagaaaccaatatcctaagatatggcatttggacatgctgagctgaagaagcctcgtggtctctctggccctccccacggccaccgtctcttccaaagcctttgtctgcctaagatccagatccaccaaagggaacaatggtttttttcttcccctttcttaagaccgagaatgagcccccacctgaacagaccctctcccaggataatgtacaagttcatttctgatccctgccccgttcattctccctagtaatcctctcaccagaactgctgttctccccctcccataacctgctttgccaggatgatatataagcttccgaaccacagtgtggggtgagcagttcctctgtgattctccccatgtacgcgtttgtgataaatgtgtacgccttttctctaattaatcagcctttcttgagttgatttttaagtgaaccttcatagggccaagcccttggcccctacaagagcaaatatggcaaaatattagcaattgttgtatctgggggatattgatagatatttatcacacttttctgcatgtttatgcatattcaagtttaaaagttgggaaagctctacctcaaaactcacttgtgcaggaagccttcctgattcactctacctgatggcctgcgttgttcctcgggacccctgcctgcagtccctattctgctcatttctgctgctgtgtctttcttcacccacgagcctgggcatcgaggccttgcacagtggcgtgtgcggggagggcctagggcctggagactgaggcgcagggctgagttctcatccactcactcgctcagcagacacaggaggagtgtgtgacctgcctgtcgctgtgctaggtgctgggactccctcaaggagtgtacactcaagagaggggggaaaacaagcagacaagcaattgcgatgccaccaaaggcacagctctcctgagtggaaagggactcctgggcctcggctgtgtaagcagtgcagggtgtgcccaggaagtgcctgcccctgttctctgcataaccgctactgctcattaaccagcgaggccttggtttctgcatttataaaatggtgttcagacaccagctcagcccactccacagggcttctctgagactcgggcaggagacaatatgtgaaaacattcagtaaactatacaaatcctgtgcagtgatcaggggttgtaattcttatgagacacaatcaggtggctaaaaagttcacctggaggccgggagcggtggctcacgactataatcccagcactttgggaggccaaggcaggcagatcacttgaggccaggaatttgagaccagcctggccaatatggtgaaaccccatctctactaaaaatacaaaaattagccaggtgtggttgcagatgcctgtaatcccagctactcaggaggctgaggcatgagaattgcttgaacccgggaggtggaggctgcagtgagccaagatggtgccactgcactccagcctaggcgacagaacaagactctgtcaaaaaaaaaaaaaaaaacccacctggaaagaggtcttgaaggctctatagagaggagacagatgaccaaatgcaatgatgacacaaaacaagaagaaaagaaatgaaagccagctaggaacatgggctgggccctgcttgttaagacccctatccatcttggggtccttagtaagaatctttgggctgcgtttccctcttttgtctgggagccggggtggggacagagttgctgctgtccattgacacatacatgccttccgttccctctccccatattccctccgtggagtctggggcctggggtccagtaccatccccactctcacccccactcaccacctccactgcttttgacctcagatgcatgctgggtggcctggctgcacccccactccgcctctacttgatcaccagctcaggtggagcaggctgggcttggggagacagtgcagccttcagcagataaaacctgaattcagttcctacgcccttcccctcccgtgtatgctgcctttgtccaagtcaccttcatggccccaagcctcagtttccccaatctataagggaataataaaggtacctatttcaagttactgtgaaaatcaaatgagattatgtctttgtaaatgttttatttttataaactaacaataagctgattcacctagatcagtggctaccattgtcgcttagtacagattcttacccttgggtcctagggaaaattcagggatttatgaacttgggtggggaaaaaagtcatctttatttccactaacctttaactgaaatgtggtatttctttagttatgaatgagggtcatagaccacagtaatatcagtagccccatggctttatctccagcagaaaccacagatttttcacaaaatgctttaaagttgttattcttgaattatctggtatgctcatcactactatgaaattgtggcatttattagacttgctactaggttttattatttcacatgttgatagggaagcacacatattattatatcataaatcattttttctttcttttttttttttttgatagctgcatttcaatagagcttgtttcctttgtaccccagtgaatttacttttatgcatttagaagcatttttctaggaacgtgtccacaggcttcacagactcccaaagggggcacaaaaataaaggatcccctggcttggtgcaagcttgaccccaactttgttcctggccttccccagccctggcttctggtcaccgtgttgggagagctgagcctccctgtttcaagagaaggcccaggtggtgaggcctcaggtttacagagcagagtggatgatggggaagccctcgcacgttctgtctctgccttttggtgtcactcacccacgcccgttatcttccattctctgatcttctctttcctctttcctttctccttcattaccccttccacccccacactctcagagccttcctttcagcctatttttgaacatccctgaggataatgtcttttctgtggctcctgggaggcgccactaccagctgtggctcgttagctgtgctggaaaaactctcgcgttgtgcctcaagggcaagaggagtctctggttccacttggcactcagagggggaccagggatgtctcaatggtgggaacaatggggagtgtgaccttggagctggaagcagggctctgaccccctgcaggagggatgagagtgccctcacctctagtgagaactgaggccctgcgccggccccagccaaacagtgagggcgtgcagaccttgcccaggaaggccaatttctcagtgcaaagggagccatggccagggaacccggcccgggtcctccacctctgaagctgagctaggcatctgcaggccagggtgaggggctgccctgtgtgacccgccggacccaggcatagagcagcacctgagtcaggctgtcccagagcactggcagcttcactgcaggggcaggctggctctgctgacgccagacgctcagtctgggcagagacttctcagtgggggcagagagtaggtgcttctctggctaatctgcctcccagctctgtgtttgataaggcccaagtccaactttacagattgcaaattgaccttatttctctttggcatcacagaaaaacaacctataatccaccaagccagatatgagcgggcctgacctgtggatcctctgcccacctgacagacatctgctcatttgtcgggaacccctcaagagacaactcctccctgcagccggcccctcacttccccccacccatggagcactgatcccagccaccagggcctgacacaagggcccatcaccatggcatctagcaaacacgtttctcacgctttgggttgtatttatctcttccccacctagctatgaattctgcaagggcgagaggaatgtgggttgaatctgctgcacatggtagcacttgataagcggttcctgaatgaatgagtgaatggcagccagtccttcccattctgaggcagaggtgcagccaggagagggcgtgtacacaggtctgactgaccacagtgggaggggactgaccctcatcccttggtcgcagctggactttccttctaggcccgatctccctggcgccccaccctgcacccatctgcctgggcccactctcctgggcatgttatcagggatgcacagactgctccatgttcgaggggactgaggcacatccatcaccctcgtgccctgggtgctgctgcatccccagagcctgactctgtgccttggacttagtagatgctcgaatcacagttcgcaaacccatgcaagagtctctgatttgggtttcgctttccttccccctgcctgtgtccactctataaaggcagaaaggaacctgctggagctgggtcctccccgagaggcttgcagttccagaacaggcaaaaacaatggcttcccacaggtttacaaaacaaggagcaggctatagccccgaggaagctgcaggaccctcatcggttccaactcctgtggaactgatgaggactaaaggggccttcctgtggccatctgggtcccggaggtgggcggctttctaggctccccagcctgccacaccccttgaggccaccccacccagcttcaagcctcagccctaacttccaaaggtgcagctgtgccagggtgcgggtggggaagacactgtctcctggggagacctccatcttacctctgaggtcagcctctgctcaggtgcagcgtcacagcagggggcctgcgttctgcttcccagtctgggagaagagagtgtctggatattttcaggaaaaaaaaagaaagttgagcagccacagcagggcagggcagtctacatcctcaagtctccctcagcttctctgctgctgccggctggcctcaaattttgcctctctttggttctctgagaagttttaccaagagaagagacaggaggagagatccagcctggactattgtttgtggggtgtgtaggtgtgtgtgtgtgtgtgtgtgtgtgtgtgtgtgtgtgtgtgtgtatgcgtgtatgtatcccgcgaggctggagccacagcttccctgatgaaccatggaggcgggccagctcctgagctgcggttgccctggagacccacctaagcctctttgcctggagcagcattatctgtagagggagtggctgatctgacacaaaagcctgaggcgacccaggcccaggcagtgagggagcacttgtgtccagatggcattctgtccgcttcctcctccagccggtgctcagtgtggcacaaactgggcaagaccattctcacccaaccctctgctgagccctaggtgtacctgctgttggcaaatgtttccagctgcctggtgggtggctcctggatggagatcccctctttctatcagctccctcctacagggaaggggtgattctgggtgctgaggacagggacctgtgaagatacatctccgcctttgccccaccacatcccttgcctgtcttcctctctgcttatctaaattatttccttccctcaaggcaagctcaagagcagacagttctgactttcagaaggaggggctgtccagggagaagaggaacatggaacagaaagcattgacgttgaggtatttgagataacatttggggatagcagaagcatcctgttgctgttctgcagcatcccacactcatgtctgggcctccttcctgtctctgctctctggtcacgctgtcacttgtagactgttctgcctagaagccatgtgtgggccagcttgcacctaacagacattaggtagcactaaaacagatgcacactgccctgtgaggggcatgggaatactgtaatgggcatgaagctgcattataatagatcttaggtaatcctgtgctgggtgatagcgtgacttttgcacacatctggttttgattgtgttggaaataaagcagaaagtacaaccaagaataaattaaacaatggctgatgaaatggactcaggttgcccacctgcctgcctgcatgatttcgtccctgggtgatttgtcacttcgtgcttgctctgtggctggttccactcagctggttccatccgccttccctcttcatccatcaagcaggcaagattcttgagtcaggagttggatcatatacttctcttgaccagttcacagcacgacagccccaaagattgagtgggtcacttggggatggaagatccccacatttgagggagctgaagctgacttcctctgacccacagttcccaggcggcctccacctcagggccagctaaggccagagtcacccaaagcaggtaactgggagtccccacctctgagcaccccaccactatcctggcactttcccaaggggcgtggcttggaggtccaagggcagaaattcccaggcatttccacactgtagggaagggagcagggggatgacaagactttaccttccctttaggaaagttgctggaggcaatgaggagaggagggcatggactaagtcacatgctcatctgtgcagcacgtatttctaaagcaccattctacaggggcaccaagctaggagctggctgagcctggctctcctctctgcacacatcccagccaagcctgtgtgtgctggattgctggatcagatgaggaggaggtggaagtctggcaggcaggtggggagcagggacagcattagggcccagagttaaagacttttatctccaagtagtacaaccttgggtctgctactgaccattctgtgtttgaataaaaacaattcatcccttttctatagccatgcttttgtattaatatctccccttctaatgcacacacaatgaatgtaaatgagatcatagaggccaatgtcttgagccatcagaaagattttgtcgcagcagctgccagatgagcttcaggactcctgaccctgggatgccagggaacaagcacacagacgacttatagcagtctccctggcagacgcagctggcccctctcctgcatttttcaaatggtgcctgtgattagaagagggaggcactccctaacccacgaccctccctgacagctgccttgataccgtaactcacaggccttggtgggtgtgttgactcctcatttattctgatttgttcacctgtggaggatttgtgattatccttgctgagtgtgaatttgctctggggagaaaaggtggcggttgtttttctcttgtttggcgtggatggaagttgctgaagcatagatattcagcaaccatcaaatgcagaaacaccggtggggcccgcaacattgcctcatagatggcatttgattaataaattggaaatgtggagttatgaggcgattacatgcaaggctggattaaaatccgcatggagattagagataagccccggctctgcgtgtgtgtgtgtgtgtgtgtgtgtgtgtgtgcacgcgcgcgctccgttctctcctccctggagtctttccaggctatttcaaaccatttctaaccactcagtcatgcgttgggttttccaaatcctgcagaaggtctgtgtagccctaatcccaaagaagttgaattaaatggacagaatattcataggtacagaccagatttgcagttacttagacctcttctctctgggcatccctctttctattcctgtggtcacatttcctctccaggtgctacggactgaatgttgtgtcctccccaaaattcaatcttgaatctcccaaggtgatggttaggaggtgggacctttcggatgtgattaggtcgtaagaggggagccctcaggaatgagattactgcccttgtgaaatggtctcagggagctttttggcccttctaccacgtgaggacactgtgagaagatgcctccatcaactaggaagtgggctttcagcagacactgaatctactggcaccttgatcttggacttcccagcctccagagctgtgagaaataaatttctgtcatttataagtcaccagtttatggtattctgtaatagaagcctgaatggactcagacatcaggtacaggaagcaatgtgtctgacggcaggaaaaatgagaatgctcccttccctgccagctagctgggaatgaggcataaagcacttctcattcattcattcattcaccaagcatttattggctatatactctgtctagactgcaccttgacactccatttccatagacttcactgaccacagcttcttcttcttcttttttttttttttgagacagagttttgctcttgttgcccaggctggagtgcaatggtgcgatcttggctcaccacaatctccacttcccaggttcaagcaattctcctgcctcagcctcccgagtagctgggagtataggcatgtaccactacgcctggctaattttgtatttttagtagagatggggtttctccatgttgaggctggtctcgaactcctgacctcaggtgatccacccgcctcagcttcccaaagtgctgggattacaggggtgagccgctgcgcccggctacagcttttcagttctgccctgtagtctgatggactaatgtgagggcctgtggcagaaacagctagctgtccaccaagagtcacatttctcctccagagtacatgaacatgtagtagacatgttcctaggaagcagctgtccagctggggacttcattccccatccctcctcccatctaggtggggccgtgtgatgatagggtgtagatggaagggacatgagtcacttcaaggtgtggcaggtagacacccctgtgcaactgtccaccttccacctttcccctttgctgatcgtcagccaggactctgaggccctcggggtgggggagacacagttttgaaggcgtttaggtccctcaatcacttcatgaaaagctgctcacccatcattcatgttgaactctaatgtgtgcaaaaaatcatatgcttgttgggtcaaagcactgagttggggtttctctgtaatagcagttggcaccacccagctcacaaaaaaccctgtgaaaaggggtgggtgtggaagtgctgccctttcctaggttcctggacatcagggctcttcctgacatgttcgccgctggttttttcaccatcaccttaaagacattacttcatcccctgttgtctcatgcccctgtgcatggtgcccactctacccagagtcccctcctacctggggaagttaacttacccctcaaagtttagcttcatggtaaccgctttgtgaattatcctctgtctgctgctccctcctctccactctgaagcctcattctttttttttttttttttttcttttgagatggagttttgctcttgttgcccaggctggagtgcaatgacacgatcttggctcactgcaacctctgcctcctgggttcaagcaattctcctgcctcagcctcccaagtagctgggattacaggcgtgtgccaccacacccagctaatttttgtatttttagtagagccaaggtttcaccatgttggccaaactggtctcgaactcctgacctcaggtgatccacccaccttggcgtcccaaagtgctgggattacaggtgtgagccactgtgcccggcctgaagcctcattcttccttctgtacacacagttgatcctcattacctaccaaagtactggcaaatttgcctactcactaaaatttatttgtaatccaaaagtcaatactcatagaactttttttttttttgatgcagagtcttgttctgttgcccaggctggatggagtgcagtgctgtgctctcagctcactgcaacctctgcctcccaggttcaagcgattctcccacctcagcctcccaagtagctggaattacaggcttgtgccaccacacccggctacttttttttttttttttttttttgagatgaagtctcgctctgtcgcccaggctggagtgcagtggcgagatctcggctcactgcaagctccacttcccaggttcatgccattctcctgcctcagcctcccaagtagctgggactacaggcacccgccactacacccagctaatttttttgtatttttttagtagagatggggtttcaccatattagccaggatggtatcaatctcctgaccttgtgatccgcctgccttggccttccaaagtgctgggattacaggcgtgagccaccacacccagactaatttttgtgttttttagtagagacaggatttcaccgtgttagccaggatggtatcaatctcctgacctggtgatccgcccgcctaggccttccaaagtgctggaattacaggcgtgtgccaccatgcccggcctaatttttgtgttttttagtggagacagggtttcactgtgttggccacgctggtctcgaactcctgagctcaagtgatcccctgcctcagcctcccaaagtgctgagattacaggtgtgagccactgcacctggcctactcatagtattagattgctgtaagagtaattgcggtttttcccattaaaagtaattacttttgcgccaacctaatacttttgtggtcattctagacatgtagaaaaatgttagtgacctgatggacttgttccctgctgagcttgaacaaggcacgctctgccttcttgtttcagctctcatgatcttaagtgtccttttcacagtctatttagtgcccacttttcatactttgtgctttttatttgtgattttgatatcgaaaatggccccaaaagtagtgctgaagggccttctagtgttcctaagtgcaaggaggcagtgacacgctttactacatgagttagatcagcttccttcaggcctgacttagcactgctggcggtgagttcagtgctaatgaatcaacaatatagagtaaataaggtgtctttcaatagaaatgcacataaaacaaggttatgtattggtcagctgacaaaaatgtcatgaccagaggcttcaggaacctcatccaggacgaggactgaacttcaccctgtatttcccctaggagcaatggttcagtgtttgctaattcacaactttatagataataactactgtgaataacaagaattggctgtgcttcacaccatttcctgagcatttaatcagcatccctgcagaagaagagctccccaaggtcaaggagatcaagccccagcacacggtaaaagctaagttcgtgtttgctgtacccacagagaacgcattagccagagtgactgggcttggtctctgtgttaaacaaatgccgtggacttgctccccactctcctgaacctgaaagagccccaagagacgtaatgtcacaggctcaaggaccacagacaacagatgtaaggaaggcaggaatggactgtggggtgccgaggtcacccagaagtccaaggatgcacattccaggggaggtgaggaggacatgtcactattagagggcggtggagagcctgggtattctccatccagctccaagcagtggaggcataagacagtcagaacctcccttctgctcaacctggaagtgcttctggaacaaggtagaataatgggaaatcaatgggaagagggagtcagccatgcggtgttgcattagagccaagaaaacctgaagtggcacaagctgcactgggcccttttgggagggctgatgaggctgtagaggggatgtgctggggcctgggaaggaaagagatgctattcgtggataatgtggtagaaggagtgactctgtggaattaaacacacacatggctcaggtgaacctggatgtcacatgtggatcttaacagattctcacatcagttcccaaagaagaaggctggtgagtccagagcaatgaagcagcctggcagagtccatctcctggctaccagaagccacctggacttggtgtggagaatgaaggagagaggggaattatcaggaaattctgactctggcagctgagttgatggcagtgagaagtggcgtccaggactgggactgagccccacggtggtgagacatggcgtccaggaggaggactgagccaatggtgatgagacatggcgtccaggaggaggactaagcccatggcagtgagacacagcgtccaggaggaagactgagccagtggtggtgagacgtggtgtccaggaggaggactgaacccatggcagtgagatactgcgtccaggagaagtagattggaggggaagcagagtgtgtctttggcttggtggaggtggaggaggagacttcatggctccagggaggagaggctcctggaccagctccatatgcagaagaaagggtttggctaaagcacacacctggaggccatcgaggtggtgttccgatccctgggccctggccaaattccagactctgttaaacaaggagcatgtgagcatttaagaaaggatgtggagatcatgtggcattagcagatgttcactgtcaacaggtcaggggaagccacccccaaagatgccatgagaaagcatggccagggacagttgcaatgcctctgtgccctcatcacatcccctcatccctcctctgcctacagggcagctctggcaggccgttctgtttgagatcaggggttcctgtaattgatagcatcccagctcaagctcacagccaccttttcactctctgccctctgaggccagggaagcccactgggcccatgtgcaagtgtggtcctgaagtgtaagtggttcatgtcaccaggacaatcttcatttgggagacaggaaccagaagatacatactccacactcctgtccaccacatggacagttctggaaggctgccgttacagttcttgagaggtgccacacaatcagacactgtggctgtgttgctcccatcagtgaccttgataacacaccctatgatgactttcctccttcctgtctcactctccttgcactctcgtttctgcttcctggactgcctcccaagtcctggaagctatacccaagtccttgttccagcatctgcttctgggaaaagcagagaggaaatatgaagaatatagggagccaagcaccgtggctcatgcctgtaatcctggcactttgagaggccaaggtgggcagatcacctgaggtcaggagtttgagaccagcctggcaaacatggtgaaaccccatccctacaaaaaatacaaagatcagctgggtgttgcagtgcacacctgtaatcccagctactccgggaggctgaggcaggagaatcatttgaacccaggaagtggaggaagttgcagtgagccgagatagcatcactgctcactgcaatctaacttgggcaacagagcaagactgtcaaaaaaaaaaaaaaaaagaatacagagtgatctgcgatgttaaatgccaagaggtccagtagaatgatggcccaggaaggggcatttgcaacagggaagggggtgcaggttactggagacactgccactggagctcggaagtgggcccagtactcccagggctaccctactgaggacatagagtctgctcttgcttgtgtgattctttacacaagtgcagcacctccatcattctccagggagtattcctaaaccagaaggtgctgaaagctttagagaagagctgaacagagaggtgttcactgcacctgcacagcatggtaaactccagcaattacccttggacgctgactctctccacagtctctccctccagccatcaccaggttccccctttactgacaccccttccctgtggctcctgcccccctactcctggatctcccttctccacacagccagcgacctctctcagcagccacctctctgagggctgggctcggatgtgaatgatgttgagacgtgagccacagcggtgaggcccaaggtcctcagttcccctgtcctctatggggttcccacatcagtaacctgcttcctcccacagcgcctttctatagagaagacaggccagggacaagagtctggttgctctaacgtgatccttccccagaagtcagaggggagaccttgctgctggcacgaggaggactgaacaattctttgtggaagcttttcccccagcgtgttctctgatagacccataagcagctggaatcctaccccctaggaactctgagtgctctgtttttcattcaccacatccagcctccctgcacactagccccatattcatttcctcaacaaaggtttactaggcatgtacttagtgccagccccagggcctggcaccaagggtggagctggagagggaaggcccacctgtgactgcatggggctcccagccagaggaggaggacaggctgtgtgcagtagggctgggagctgtgcagaaacccagagatgcccctggaaggtggcccctgcctcctggctcccactccctcaccatacaccccgttctttcatccctgggtgctctactaagaatcctgaaacagtagagcaatggggagcttcgataccctttactcccacacctgctgagatcacggactcagaagaggctagcaacttgctcatttagcacagcaagtgagtaacaaagccaggacaatagcctatgttctttttgttccaaaccattgccctgcccactgctgaccttgtggcatcagcaaatcagatagaagcctctgggccca

SEQ ID NO: 675 - DNA, 20061 bp, Homo sapiens
acactgtaaacatcacataaaagtaagagactcttgtgattatgatccttaaagcatccccaggattgtgcccagagaaagggcctcctgaatcctcactaactcccaacaaagctggaaacacatggactatggctgagcacaagctttccctatgacttaaggggaacacacacacacacactcagaacagatacatcctatgtcagtctaccaggaaaacaccctcagcttctaaatgcctccagcctattgacgaaagacacttagaactctatggggttggccagccatggtggttcacacctgcaatcccaatactttgggaggccaagatgggcagatcacctgaggttgggagatcaagacaagcctgaccaacatggagaaaccctgtctctactaaaaatacaaaattagccagatgtggtggtgcatgcctgtaatcccagctactcgggaggctgaggcaggagaattgcctgaacccgggaggtggaggttggggtgagccaagatcacaccattgcactccagcctgggcaaaaagagcaaaactccgtttaaaaaaaaaactgtatggattaacattaacctgaaaaaaaccaacttacccaccattcattcattcagcattaatcaagcactgtgtacacatctgtggagggacataaacacgaaaggatgatgccaggatcctgctctccaggagaggcaagatttgttgagtaaacgctgcaacatcaatggagagagggaactctgctggtgaagcatagagtcagcactgatgtgggaggggaaggtgtgaccctagatggtgaaaagtgccagagtgggctgagaggtgagtgcgggcttcagacacatgggctgatggagaaggggtcccaggtggagggaggatccagccatagaacaaggtgagacaggtggaggtctgacagcagcgagcctaactcatcatggagcccccacacaggcctgctaaatacaaatttagtgaaggacagaccgagtagatgaatgaacgaatgaatgaatgggtgaatgagctactccatgacctgtcagatgtggtctgtgcttctgacaacagtgaagggaaatgacattcccgagctaaagcctgaagtgggtcttcgaggggtctcacttcatctttctgcacctttctccctccaagccgttcccccttccatgcaccaatgatcccatttctgcttagaccctccatacgcagagaaaagaggtcagatgaactcagtctcaacagcatggtgatgaaggaggtgtcacctccagaggacacatgcatttttaggccaccctcccatcaccctgcaccccagtgcttaatgcagagaaatgaattgttaaggtaaataatcagacacaaaggagaatattatgatggggtagcagcagccttctggaaggccacagctaaatctctacttaccgatggagacttgaatgaccaactcctttagcaaccaacagaattaagaaatctgaaaacaggccaggcatgatggctcatgcctgtgattccagcactttgggaggccgaggagggcagctcacttgaagccaggagtttgagaccatcctggccaacatggtgaaaccccatctctactaagaatacaaaaattagctgggcatggtggcacatgcctgtagtcccagctactcaggaggctgaggcaggagaattgcttgaactggggaggcggagtgagctgagatggtgccactgcattccagcctgggtgacagagcgagactccaactcaaaaaaaaaaaaaaagaaatctgagaactttcattctccacgcaacctaagcctatcaccaatggaggcttcagattacacagctgaccgcttcctgggagagtgggacgaaaggacgaaccattagaccctactcctggggtcagtagcagctaggacgtttacttcttagcccttacctgctttatgtgcccagaataaagaggttgggtagtactgtgtgtactggggggtgggagtgcaggggtgggggtgtcatggccagagagccatgagcatcaggagcctcgcctaaggctaaaggattccatcagttcaggcacaaggactgtaactgtaactgaatgtgtcactttccctggagtgtttgtatttttaaaagtctatgggttagattgatgcttagcaccaaaagagtgaatggtgtagccactgaagagcactgcgagcatgcggagtcactgttcctgcaagggctactgaatgtgctgggctactgcacagctccatgcctttgtcatgttcctccctctgcctgaaatgcccgcccattctacatggagaccaggtctagggtcagcaccctcggaagcttttcttgaccttcccatctccgaggtagatgtggccactctctaccttgtcccctgactgcactctgcacaggtgcttttcagagctcaggagcactttacggaacgtgactgcctacctcccctgaccccgggtgtggtatgtggtcagggcctgtgccttattcacctttccatccctggggctggacatgtagtcagtaggcacttaataaatagcaaacaaatgaatgaatgaatgcccgaacaaaggaacgaataaatgatggagaagctataacagttggatcaaggaacaagccccacagacctgacctgacctgatcctgaacaagaaggcattttccaaagctccttagggagcttttttttcttcttaatctgggtttgaatttgagctgaaagaagagagcaagagagtggcttggcagcagagggttctcctgtggccgggagaaatgtgagagaagaaatggaagacactgaagaaaacttttgcctccagggcaaattgactgcagaatatccatgccacagccacataagctaacaaactattaaataaagtatgttccgtttcctcccttgtgaactataccttcctaacaacatggagggtgagattcagacagcattcttggactcctcagagttcttctctgacacatggaggtgggttgggactgctctcggccctcagcctgcctccctctcttcccacctccgcttcatcccacatggtaaggggccttgcaaacacgtgtggggacaccccagctttcacctccaaggcccagccacacccctgcaaccagccacctctgtgccaccctctgacttagggttgctcgctggcagtgctgtctgccctgctcagtggccccttctgtggggaagtgggcgggcgactgtctggcagggaattctgatttcagtccctaagcctgacctcgaagggaagtgcccacagggtggcatgtctcctggacccccagacacttcacctcaaggcagagtaaggccagaagcaagcccgagtacagtctggggtgcagcctgtatggggtcctgcttccctgggcttaaggctcccgacctgagctggccgctagagaaggtgctttgtgacccacctcccccatctccagatggcaggggctgagtggagtgatcccacctgagtcctgaattttgtgggctctaagcctctttggcccaggtgtagggtctcaacaggggaggagggtgttctgagtcatctcctccccatcccctcacttcccgcaactctggccaggactggaggctttggcagaaacaagatttctgctggtgctatttctgtccccagtgccagctgctcccccagaaggctcttcagtgggtccgattaagttcttaagggcaaaggagggagggagagacagagggaggaagaacagagacagagaggcaggagggcaggctagacagactccagagggggctgccttatcccagggtatccccagaacctgaacctcggctgagactgggaaggacgtggtgcctgggggaggtctgttaaacaacagaaagagtgacctttggtgagtgtctggcacaattttctacactgcctggctccagattcaccaccgtggcagagccaactcctcagtgtaagccccaaggcccccgcacttggctcaccacctggcgagtggcagcgccatggtgacctcagagtcttcccatgatgaatggttcccactcagtcaaaggcacttacaacctgcctcaaacacatgaacactgattgaatccttgttttaaaaaattaggataggccaggcacgatggctcatgcctgtaatcccagcactttgggaggcttgagttcaggagttcgagaccagcctgggcaacatggtgaaactccgtctctaccaaaaatataaaaaattagctgggcgttgtggcatgcgcctgtagttccaactactcaggaggctgaggtgggaggataacttgagctaacttgagcctgggaggtagcggttgcagtgagttgagatcgcgccactgcactccagcctgggtgacagagtgagaccccatctcaaaaaaaaaaaaaaggagataccctttatcaagttaggaaagatccccttctttatatttaaaagaaaaaaaggctgggtgtggtggctcacacctataatcccagcactttgggaggccaaggtgggtggatcacctgaggtcacgagttcgagaccagcctgggcaacacagtgaaaccccgtctctactaaaaatacaaacattagctgggcatggtggcgggcacctgtaattccagctagtcgggaggtggaagaatcgattgaacctgggaggcagaggttgcagtgagctgagatcgtgccattgcactccagcctgggcaacaaagagagactccgactcaaacaaaaaaaaattaggataactgaggaaatctgaatatgagctggatgttagaaaataatccatggggctgggcacggtggctcacatctgtcatctcagcactttgggaggccggtgcaagtggatcacctgaggtcaggagttcgagaccagcctggccaacatggtgaaatcccgtctctactaataatacaaaaattagccaggcatgcatgcctgtaatcccggctacttgggaggctaaggcaggagaatggcttgaacccgggaggcagaggttgcagtgagccgagattgcaccattgcactccagcctgggtgacaagagcgaaactctgtctccaaaaaagaaaagaaaaaaagaaaactatctgtggaatattggccaatagctcaatcttaggaggtgctgaagtgtttatgggtgtctacaatatcttacattcaaatagttcagaaaacattacataaatatgtatacacacaccccataaacaggatgttggggctcagaaaccaatatcctaagatatggcatttggacatgctgagctgaagaagcctcgtggtctctctggccctccccacggccaccgtctcttccaaagcctttgtctgcctaagatccagatccaccaaagggaacaatggtttttttcttcccctttcttaagaccgagaatgagcccccacctgaacagaccctctcccaggataatgtacaagttcatttctgatccctgccccgttcattctccctagtaatcctctcaccagaactgctgttctccccctcccataacctgctttgccaggatgatatataagcttccgaaccacagtgtggggtgagcagttcctctgtgattctccccatgtacgcgtttgtgataaatgtgtacgccttttctctaattaatcagcctttcttgagttgatttttaagtgaaccttcatagggccaagcccttggcccctacaagagcaaatatggcaaaatattagcaattgttgtatctgggggatattgatagatatttatcacacttttctgcatgtttatgcatattcaagtttaaaagttgggaaagctctacctcaaaactcacttgtgcaggaagccttcctgattcactctacctgatggcctgcgttgttcctcgggacccctgcctgcagtccctattctgctcatttctgctgctgtgtctttcttcacccacgagcctgggcatcgaggccttgcacagtggcgtgtgcggggagggcctagggcctggagactgaggcgcagggctgagttctcatccactcactcgctcagcagacacaggaggagtgtgtgacctgcctgtcgctgtgctaggtgctgggactccctcaaggagtgtacactcaagagaggggggaaaacaagcagacaagcaattgcgatgccaccaaaggcacagctctcctgagtggaaagggactcctgggcctcggctgtgtaagcagtgcagggtgtgcccaggaagtgcctgcccctgttctctgcataaccgctactgctcattaaccagcgaggccttggtttctgcatttataaaatggtgttcagacaccagctcagcccactccacagggcttctctgagactcgggcaggagacaatatgtgaaaacattcagtaaactatacaaatcctgtgcagtgatcaggggttgtaattcttatgagacacaatcaggtggctaaaaagttcacctggaggccgggagcggtggctcacgactataatcccagcactttgggaggccaaggcaggcagatcacttgaggccaggaatttgagaccagcctggccaatatggtgaaaccccatctctactaaaaatacaaaaattagccaggtgtggttgcagatgcctgtaatcccagctactcaggaggctgaggcatgagaattgcttgaacccgggaggtggaggctgcagtgagccaagatggtgccactgcactccagcctaggcgacagaacaagactctgtcaaaaaaaaaaaaaaaaacccacctggaaagaggtcttgaaggctctatagagaggagacagatgaccaaatgcaatgatgacacaaaacaagaagaaaagaaatgaaagccagctaggaacatgggctgggccctgcttgttaagacccctatccatcttggggtccttagtaagaatctttgggctgcgtttccctcttttgtctgggagccggggtggggacagagttgctgctgtccattgacacatacatgccttccgttccctctccccatattccctccgtggagtctggggcctggggtccagtaccatccccactctcacccccactcaccacctccactgcttttgacctcagatgcatgctgggtggcctggctgcacccccactccgcctctacttgatcaccagctcaggtggagcaggctgggcttggggagacagtgcagccttcagcagataaaacctgaattcagttcctacgcccttcccctcccgtgtatgctgcctttgtccaagtcaccttcatggccccaagcctcagtttccccaatctataagggaataataaaggtacctatttcaagttactgtgaaaatcaaatgagattatgtctttgtaaatgttttatttttataaactaacaataagctgattcacctagatcagtggctaccattgtcgcttagtacagattcttacccttgggtcctagggaaaattcagggatttatgaacttgggtggggaaaaaagtcatctttatttccactaacctttaactgaaatgtggtatttctttagttatgaatgagggtcatagaccacagtaatatcagtagccccatggctttatctccagcagaaaccacagatttttcacaaaatgctttaaagttgttattcttgaattatctggtatgctcatcactactatgaaattgtggcatttattagacttgctactaggttttattatttcacatgttgatagggaagcacacatattattatatcataaatcattttttctttcttttttttttttttgatagctgcatttcaatagagcttgtttcctttgtaccccagtgaatttacttttatgcatttagaagcatttttctaggaacgtgtccacaggcttcacagactcccaaagggggcacaaaaataaaggatcccctggcttggtgcaagcttgaccccaactttgttcctggccttccccagccctggcttctggtcaccgtgttgggagagctgagcctccctgtttcaagagaaggcccaggtggtgaggcctcaggtttacagagcagagtggatgatggggaagccctcgcacgttctgtctctgccttttggtgtcactcacccacgcccgttatcttccattctctgatcttctctttcctctttcctttctccttcattaccccttccacccccacactctcagagccttcctttcagcctatttttgaacatccctgaggataatgtcttttctgtggctcctgggaggcgccactaccagctgtggctcgttagctgtgctggaaaaactctcgcgttgtgcctcaagggcaagaggagtctctggttccacttggcactcagagggggaccagggatgtctcaatggtgggaacaatggggagtgtgaccttggagctggaagcagggctctgaccccctgcaggagggatgagagtgccctcacctctagtgagaactgaggccctgcgccggccccagccaaacagtgagggcgtgcagaccttgcccaggaaggccaatttctcagtgcaaagggagccatggccagggaacccggcccgggtcctccacctctgaagctgagctaggcatctgcaggccagggtgaggggctgccctgtgtgacccgccggacccaggcatagagcagcacctgagtcaggctgtcccagagcactggcagcttcactgcaggggcaggctggctctgctgacgccagacgctcagtctgggcagagacttctcagtgggggcagagagtaggtgcttctctggctaatctgcctcccagctctgtgtttgataaggcccaagtccaactttacagattgcaaattgaccttatttctctttggcatcacagaaaaacaacctataatccaccaagccagatatgagcgggcctgacctgtggatcctctgcccacctgacagacatctgctcatttgtcgggaacccctcaagagacaactcctccctgcagccggcccctcacttccccccacccatggagcactgatcccagccaccagggcctgacacaagggcccatcaccatggcatctagcaaacacgtttctcacgctttgggttgtatttatctcttccccacctagctatgaattctgcaagggcgagaggaatgtgggttgaatctgctgcacatggtagcacttgataagcggttcctgaatgaatgagtgaatggcagccagtccttcccattctgaggcagaggtgcagccaggagagggcgtgtacacaggtctgactgaccacagtgggaggggactgaccctcatcccttggtcgcagctggactttccttctaggcccgatctccctggcgccccaccctgcacccatctgcctgggcccactctcctgggcatgttatcagggatgcacagactgctccatgttcgaggggactgaggcacatccatcaccctcgtgccctgggtgctgctgcatccccagagcctgactctgtgccttggacttagtagatgctcgaatcacagttcgcaaacccatgcaagagtctctgatttgggtttcgctttccttccccctgcctgtgtccactctataaaggcagaaaggaacctgctggagctgggtcctccccgagaggcttgcagttccagaacaggcaaaaacaatggcttcccacaggtttacaaaacaaggagcaggctatagccccgaggaagctgcaggaccctcatcggttccaactcctgtggaactgatgaggactaaaggggccttcctgtggccatctgggtcccggaggtgggcggctttctaggctccccagcctgccacaccccttgaggccaccccacccagcttcaagcctcagccctaacttccaaaggtgcagctgtgccagggtgcgggtggggaagacactgtctcctggggagacctccatcttacctctgaggtcagcctctgctcaggtgcagcgtcacagcagggggcctgcgttctgcttcccagtctgggagaagagagtgtctggatattttcaggaaaaaaaaagaaagttgagcagccacagcagggcagggcagtctacatcctcaagtctccctcagcttctctgctgctgccggctggcctcaaattttgcctctctttggttctctgagaagttttaccaagagaagagacaggaggagagatccagcctggactattgtttgtggggtgtgtaggtgtgtgtgtgtgtgtgtgtgtgtgtgtgtgtgtgtgtgtgtgtatgcgtgtatgtatcccgcgaggctggagccacagcttccctgatgaaccatggaggcgggccagctcctgagctgcggttgccctggagacccacctaagcctctttgcctggagcagcattatctgtagagggagtggctgatctgacacaaaagcctgaggcgacccaggcccaggcagtgagggagcacttgtgtccagatggcattctgtccgcttcctcctccagccggtgctcagtgtggcacaaactgggcaagaccattctcacccaaccctctgctgagccctaggtgtacctgctgttggcaaatgtttccagctgcctggtgggtggctcctggatggagatcccctctttctatcagctccctcctacagggaaggggtgattctgggtgctgaggacagggacctgtgaagatacatctccgcctttgccccaccacatcccttgcctgtcttcctctctgcttatctaaattatttccttccctcaaggcaagctcaagagcagacagttctgactttcagaaggaggggctgtccagggagaagaggaacatggaacagaaagcattgacgttgaggtatttgagataacatttggggatagcagaagcatcctgttgctgttctgcagcatcccacactcatgtctgggcctccttcctgtctctgctctctggtcacgctgtcacttgtagactgttctgcctagaagccatgtgtgggccagcttgcacctaacagacattaggtagcactaaaacagatgcacactgccctgtgaggggcatgggaatactgtaatgggcatgaagctgcattataatagatcttaggtaatcctgtgctgggtgatagcgtgacttttgcacacatctggttttgattgtgttggaaataaagcagaaagtacaaccaagaataaattaaacaatggctgatgaaatggactcaggttgcccacctgcctgcctgcatgatttcgtccctgggtgatttgtcacttcgtgcttgctctgtggctggttccactcagctggttccatccgccttccctcttcatccatcaagcaggcaagattcttgagtcaggagttggatcatatacttctcttgaccagttcacagcacgacagccccaaagattgagtgggtcacttggggatggaagatccccacatttgagggagctgaagctgacttcctctgacccacagttcccaggcggcctccacctcagggccagctaaggccagagtcacccaaagcaggtaactgggagtccccacctctgagcaccccaccactatcctggcactttcccaaggggcgtggcttggaggtccaagggcagaaattcccaggcatttccacactgtagggaagggagcagggggatgacaagactttaccttccctttaggaaagttgctggaggcaatgaggagaggagggcatggactaagtcacatgctcatctgtgcagcacgtatttctaaagcaccattctacaggggcaccaagctaggagctggctgagcctggctctcctctctgcacacatcccagccaagcctgtgtgtgctggattgctggatcagatgaggaggaggtggaagtctggcaggcaggtggggagcagggacagcattagggcccagagttaaagacttttatctccaagtagtacaaccttgggtctgctactgaccattctgtgtttgaataaaaacaattcatcccttttctatagccatgcttttgtattaatatctccccttctaatgcacacacaatgaatgtaaatgagatcatagaggccaatgtcttgagccatcagaaagattttgtcgcagcagctgccagatgagcttcaggactcctgaccctgggatgccagggaacaagcacacagacgacttatagcagtctccctggcagacgcagctggcccctctcctgcatttttcaaatggtgcctgtgattagaagagggaggcactccctaacccacgaccctccctgacagctgccttgataccgtaactcacaggccttggtgggtgtgttgactcctcatttattctgatttgttcacctgtggaggatttgtgattatccttgctgagtgtgaatttgctctggggagaaaaggtggcggttgtttttctcttgtttggcgtggatggaagttgctgaagcatagatattcagcaaccatcaaatgcagaaacaccggtggggcccgcaacattgcctcatagatggcatttgattaataaattggaaatgtggagttatgaggcgattacatgcaaggctggattaaaatccgcatggagattagagataagccccggctctgcgtgtgtgtgtgtgtgtgtgtgtgtgtgtgtgcacgcgcgcgctccgttctctcctccctggagtctttccaggctatttcaaaccatttctaaccactcagtcatgcgttgggttttccaaatcctgcagaaggtctgtgtagccctaatcccaaagaagttgaattaaatggacagaatattcataggtacagaccagatttgcagttacttagacctcttctctctgggcatccctctttctattcctgtggtcacatttcctctccaggtgctacggactgaatgttgtgtcctccccaaaattcaatcttgaatctcccaaggtgatggttaggaggtgggacctttcggatgtgattaggtcgtaagaggggagccctcaggaatgagattactgcccttgtgaaatggtctcagggagctttttggcccttctaccacgtgaggacactgtgagaagatgcctccatcaactaggaagtgggctttcagcagacactgaatctactggcaccttgatcttggacttcccagcctccagagctgtgagaaataaatttctgtcatttataagtcaccagtttatggtattctgtaatagaagcctgaatggactcagacatcaggtacaggaagcaatgtgtctgacggcaggaaaaatgagaatgctcccttccctgccagctagctgggaatgaggcataaagcacttctcattcattcattcattcaccaagcatttattggctatatactctgtctagactgcaccttgacactccatttccatagacttcactgaccacagcttcttcttcttcttttttttttttttgagacagagttttgctcttgttgcccaggctggagtgcaatggtgcgatcttggctcaccacaatctccacttcccaggttcaagcaattctcctgcctcagcctcccgagtagctgggagtataggcatgtaccactacgcctggctaattttgtatttttagtagagatggggtttctccatgttgaggctggtctcgaactcctgacctcaggtgatccacccgcctcagcttcccaaagtgctgggattacaggggtgagccgctgcgcccggctacagcttttcagttctgccctgtagtctgatggactaatgtgagggcctgtggcagaaacagctagctgtccaccaagagtcacatttctcctccagagtacatgaacatgtagtagacatgttcctaggaagcagctgtccagctggggacttcattccccatccctcctcccatctaggtggggccgtgtgatgatagggtgtagatggaagggacatgagtcacttcaaggtgtggcaggtagacacccctgtgcaactgtccaccttccacctttcccctttgctgatcgtcagccaggactctgaggccctcggggtgggggagacacagttttgaaggcgtttaggtccctcaatcacttcatgaaaagctgctcacccatcattcatgttgaactctaatgtgtgcaaaaaatcatatgcttgttgggtcaaagcactgagttggggtttctctgtaatagcagttggcaccacccagctcacaaaaaaccctgtgaaaaggggtgggtgtggaagtgctgccctttcctaggttcctggacatcagggctcttcctgacatgttcgccgctggttttttcaccatcaccttaaagacattacttcatcccctgttgtctcatgcccctgtgcatggtgcccactctacccagagtcccctcctacctggggaagttaacttacccctcaaagtttagcttcatggtaaccgctttgtgaattatcctctgtctgctgctccctcctctccactctgaagcctcattctttttttttttttttttttcttttgagatggagttttgctcttgttgcccaggctggagtgcaatgacacgatcttggctcactgcaacctctgcctcctgggttcaagcaattctcctgcctcagcctcccaagtagctgggattacaggcgtgtgccaccacacccagctaatttttgtatttttagtagagccaaggtttcaccatgttggccaaactggtctcgaactcctgacctcaggtgatccacccaccttggcgtcccaaagtgctgggattacaggtgtgagccactgtgcccggcctgaagcctcattcttccttctgtacacacagttgatcctcattacctaccaaagtactggcaaatttgcctactcactaaaatttatttgtaatccaaaagtcaatactcatagaactttttttttttttgatgcagagtcttgttctgttgcccaggctggatggagtgcagtgctgtgctctcagctcactgcaacctctgcctcccaggttcaagcgattctcccacctcagcctcccaagtagctggaattacaggcttgtgccaccacacccggctacttttttttttttttttttttttgagatgaagtctcgctctgtcgcccaggctggagtgcagtggcgagatctcggctcactgcaagctccacttcccaggttcatgccattctcctgcctcagcctcccaagtagctgggactacaggcacccgccactacacccagctaatttttttgtatttttttagtagagatggggtttcaccatattagccaggatggtatcaatctcctgaccttgtgatccgcctgccttggccttccaaagtgctgggattacaggcgtgagccaccacacccagactaatttttgtgttttttagtagagacaggatttcaccgtgttagccaggatggtatcaatctcctgacctggtgatccgcccgcctaggccttccaaagtgctggaattacaggcgtgtgccaccatgcccggcctaatttttgtgttttttagtggagacagggtttcactgtgttggccacgctggtctcgaactcctgagctcaagtgatcccctgcctcagcctcccaaagtgctgagattacaggtgtgagccactgcacctggcctactcatagtattagattgctgtaagagtaattgcggtttttcccattaaaagtaattacttttgcgccaacctaatacttttgtggtcattctagacatgtagaaaaatgttagtgacctgatggacttgttccctgctgagcttgaacaaggcacgctctgccttcttgtttcagctctcatgatcttaagtgtccttttcacagtctatttagtgcccacttttcatactttgtgctttttatttgtgattttgatatcgaaaatggccccaaaagtagtgctgaagggccttctagtgttcctaagtgcaaggaggcagtgacacgctttactacatgagttagatcagcttccttcaggcctgacttagcactgctggcggtgagttcagtgctaatgaatcaacaatatagagtaaataaggtgtctttcaatagaaatgcacataaaacaaggttatgtattggtcagctgacaaaaatgtcatgaccagaggcttcaggaacctcatccaggacgaggactgaacttcaccctgtatttcccctaggagcaatggttcagtgtttgctaattcacaactttatagataataactactgtgaataacaagaattggctgtgcttcacaccatttcctgagcatttaatcagcatccctgcagaagaagagctccccaaggtcaaggagatcaagccccagcacacggtaaaagctaagttcgtgtttgctgtacccacagagaacgcattagccagagtgactgggcttggtctctgtgttaaacaaatgccgtggacttgctccccactctcctgaacctgaaagagccccaagagacgtaatgtcacaggctcaaggaccacagacaacagatgtaaggaaggcaggaatggactgtggggtgccgaggtcacccagaagtccaaggatgcacattccaggggaggtgaggaggacatgtcactattagagggcggtggagagcctgggtattctccatccagctccaagcagtggaggcataagacagtcagaacctcccttctgctcaacctggaagtgcttctggaacaaggtagaataatgggaaatcaatgggaagagggagtcagccatgcggtgttgcattagagccaagaaaacctgaagtggcacaagctgcactgggcccttttgggagggctgatgaggctgtagaggggatgtgctggggcctgggaaggaaagagatgctattcgtggataatgtggtagaaggagtgactctgtggaattaaacacacacatggctcaggtgaacctggatgtcacatgtggatcttaacagattctcacatcagttcccaaagaagaaggctggtgagtccagagcaatgaagcagcctggcagagtccatctcctggctaccagaagccacctggacttggtgtggagaatgaaggagagaggggaattatcaggaaattctgactctggcagctgagttgatggcagtgagaagtggcgtccaggactgggactgagccccacggtggtgagacatggcgtccaggaggaggactgagccaatggtgatgagacatggcgtccaggaggaggactaagcccatggcagtgagacacagcgtccaggaggaagactgagccagtggtggtgagacgtggtgtccaggaggaggactgaacccatggcagtgagatactgcgtccaggagaagtagattggaggggaagcagagtgtgtctttggcttggtggaggtggaggaggagacttcatggctccagggaggagaggctcctggaccagctccatatgcagaagaaagggtttggctaaagcacacacctggaggccatcgaggtggtgttccgatccctgggccctggccaaattccagactctgttaaacaaggagcatgtgagcatttaagaaaggatgtggagatcatgtggcattagcagatgttcactgtcaacaggtcaggggaagccacccccaaagatgccatgagaaagcatggccagggacagttgcaatgcctctgtgccctcatcacatcccctcatccctcctctgcctacagggcagctctggcaggccgttctgtttgagatcaggggttcctgtaattgatagcatcccagctcaagctcacagccaccttttcactctctgccctctgaggccagggaagcccactgggcccatgtgcaagtgtggtcctgaagtgtaagtggttcatgtcaccaggacaatcttcatttgggagacaggaaccagaagatacatactccacactcctgtccaccacatggacagttctggaaggctgccgttacagttcttgagaggtgccacacaatcagacactgtggctgtgttgctcccatcagtgaccttgataacacaccctatgatgactttcctccttcctgtctcactctccttgcactctcgtttctgcttcctggactgcctcccaagtcctggaagctatacccaagtccttgttccagcatctgcttctgggaaaagcagagaggaaatatgaagaatatagggagccaagcaccgtggctcatgcctgtaatcctggcactttgagaggccaaggtgggcagatcacctgaggtcaggagtttgagaccagcctggcaaacatggtgaaaccccatccctacaaaaaatacaaagatcagctgggtgttgcagtgcacacctgtaatcccagctactccgggaggctgaggcaggagaatcatttgaacccaggaagtggaggaagttgcagtgagccgagatagcatcactgctcactgcaatctaacttgggcaacagagcaagactgtcaaaaaaaaaaaaaaaaagaatacagagtgatctgcgatgttaaatgccaagaggtccagtagaatgatggcccaggaaggggcatttgcaacagggaagggggtgcaggttactggagacactgccactggagctcggaagtgggcccagtactcccagggctaccctactgaggacatagagtctgctcttgcttgtgtgattctttacacaagtgcagcacctccatcattctccagggagtattcctaaaccagaaggtgctgaaagctttagagaagagctgaacagagaggtgttcactgcacctgcacagcatggtaaactccagcaattacccttggacgctgactctctccacagtctctccctccagccatcaccaggttccccctttactgacaccccttccctgtggctcctgcccccctactcctggatctcccttctccacacagccagcgacctctctcagcagccacctctctgagggctgggctcggatgtgaatgatgttgagacgtgagccacagcggtgaggcccaaggtcctcagttcccctgtcctctatggggttcccacatcagtaacctgcttcctcccacagcgcctttctatagagaagacaggccagggacaagagtctggttgctctaacgtgatccttccccagaagtcagaggggagaccttgctgctggcacgaggaggactgaacaattctttgtggaagcttttcccccagcgtgttctctgatagacccataagcagctggaatcctaccccctaggaactctgagtgctctgtttttcattcaccacatccagcctccctgcacactagccccatattcatttcctcaacaaaggtttactaggcatgtacttagtgccagccccagggcctggcaccaagggtggagctggagagggaaggcccacctgtgactgcatggggctcccagccagaggaggaggacaggctgtgtgcagtagggctgggagctgtgcagaaacccagagatgcccctggaaggtggcccctgcctcctggctcccactccctcaccatacaccccgttctttcatccctgggtgctctactaagaatcctgaaacagtagagcaatggggagcttcgataccctttactcccacacctgctgagatcacggactcagaagaggctagcaacttgctcatttagcacagcaagtgagtaacaaagccaggacaatagcctatgttctttttgttccaaaccattgccctgcccactgctgaccttgtggcatcagcaaatcagatagaagcctctgggccca

SEQ ID NO: 676 - DNA, 1252 bp, Homo sapiens
agtttcagcaactaaagagtcagaagtaatccctgtgtatgtaagatcatgaaggaaagtaagatttaccaatttaatacttcaactagaagtcaataacatgaaaaatacatacatacaatgatttcccagtgatcttcatgggctccacatactgaatagtgattgatttgaagtgtgacttataacttgttttttcacgttaagctctgtagcagtgtcttgctacatcaggctaccctcgtagccagcccccgagactgctgtacgtagattcttgacaccctttcaagactctgaacatatctccagtctcctattcactctcaagagagctctcttagggactaatcactggccttctacccttacaccacaccttggatcaattttcttgactcactaaggttaactcacacaacctcccaatcccattcctccccaggatgaccacatggttactgccttggacagtgggcaaaaactgtcttgcattaatagttttcatggtagcccaaacacaatcaccaaaatgaaaggaaggaaatcagactgtgccaggcacactgtggctagaggctgacaccctaagtgaggtcaatagggtgcaacaaaggcatggattcctgtcttctctttttattccttttaaaacactaccatgttttaaccaaataactgaattgtagcctcattctcaaagaatctactattatctattttatgtccttcttaccacatgtagtgggttacttagctacatgacttgattgttccccagttaaatctactctttttttttgagatggagtttcgctcttgttgtccaggctggagtgcagtggcgtgatcttcattcactccaaattccactttctgggttcaaacgattctcctgcctcagcctcctgagtatctgggattacaagcacgcaccaccacaactggctaatttttcttttctgtttttttttttttttttttttttttttaaagacaagacagggtttcaccacgttggtcaggctggtctcaaactcctgacctcaggtgatccacctgccttggcctcccaaagtgccgggattacaggcgtgagctaccgtatgcagcctaaatctactattaaaggaaaaagatttgtcaccttttaagataacaagaagaatccaatttattttctaaagatagcttgttttttctttccattcatataacaagtatcgtaagcaattataatgtcactcgtgtt

SEQ ID NO: 677 - DNA, 10879 bp, Homo sapiens
tttgattggttgttttaagtcacagagtcctttagaatctgattaaacgtatggatcccccaccccaccacacacacaaaccaactttgcataaaatgtcatggagttcattatgctctagcagctttgtgactgacctattgtatacagtgagcaaacccatcatctgtcagctgaaacaaaatacatctgcttgctacagagtggggacagggagtgggcatcatttcgtaagcagatccatgggaggcgttttggaggcagtgacatttcagctgatatataactggtaaaaagtaagcctcacagaaatctggcataagtacatttcacgtggaagaaatagcaagtgccaaagtcctggggcgggagtgaatttggtgtattgaatgagctaaaaggagaagtgctggaacagtgtgagccagaggtaaatgacgtccaagaggaagacaggttctaggtcccatacagggttttgcagaccagagggcagagcttggattttattttaactgcaataggaacccactaaagagtttaagcagggtaatgatatggatattatcgtgatttttcaaagatcactgtcaagaatgtagaaaatgaggaaggggtgatgatgccaaaaagggaagaccagctatgaacctatcacaatagtatgagcagagataatacaatgatggcttggaacaaactataaactgtagaaaattcagaaaaaaggtggaaaaattcaagattcaggacacattttgaggcagaactgacagaacttagcgatgtgggataagcaacctagcagtaactggtaccatttactgtgatgaagattacccaggcaggaaaaggctgaagaggaggatgatcaagaggtcagctctgaacacaccaactttaaaatgccttttctttcatcatccaaacagacgtatctggtaggcaacaggttccatctcctaccccccatcctcctgctggatatccctcgtataacagatctgtttttccaggaacaaaattgggacccaaaacatagctgcctcccagacaaccttagcccttgaagtaatacacaaggttattttcatatatgctcaaatttccgaatgtatttgttcatgtcagacagtaacatactcataactggaaataattaaaagattaattcaaaggagactatattttccctgtctcataggcaattaaactaagacacttaatctctcaactgatttctcctgaacaagaaataagagataaaaatctaatcttctgacctgtaagccagggccatcacatggatataatttcacaataactgttatgcactgaattgtgtcccccaaaaagatgtttgagtcttcacccctcagttactgtgaatgtgacctaatttggaaaaagaggctctagacgatcaagttaagatgagaacattagggtgagcccttaatataagtggtattcgtatgaaaagaggaaatttgacacagagagaagcaagcactcaaggaagaatgccaggtgtacatgaaagcaaagaccagagtgatacatctccaagtcaaggaacagcaaagattgctaggggaaaggcaaggagcagattctccctcacagcccacagaaggaaccaaccctgtcatcatcttgatcttagactcctagcctacagaactagagagacaatacatttctgttgttctaagccacccagtttttggttctttgttatggcagccttaggaaactaatataataactgtaagacctatactttcacaattttgagtctagattcaaaatttaactggaaaatttaaaaacatctatttgaattatataaaaggcattaatttttttcctccaatttggcaaagctgtctactaagctttgtaacttggacaagtcatcctctttgagctttggttttcttatttgtaaattaagacacagttttaaagatcaaactaagataatgtacaataggttactttgcagactttgaaagttacacaaacatcaagtaccattattatcaacaagattacatgattgttatctagtaaaaaatacagttgtactatatacatcaaaccgtaattacttacctacagaagatgtgctcacatcctcctaaacacacaggctctctcagaatgttagtactgtttgaagaaattaaaacaatcaagatttgagtcattgttagataaacatctcacacccaatatttcatccaaggcccaacactaccatatttctcactttctcaaagcagaaggtattaaggatgcattcatttgaaaggctgttactccctggttaaatattgtaccataacatacctgatgattttaaatagtaaccaccaaactgggtacaagttgtaatacattttaaaatgtattttctagaaagttggagaaaggaacaattttgttcaagtatctctaaacctcttaaggcaaaaccaactactggctgcttctttcaactactaaggtgtatcttccccttatgattcaaagtgtagaccatatacctcaaaatgtgtcccacacgtagaatgaccatataacgtatcatccaaatgagaaaacttctgagagtgaagaggagtgataattgaataggatgctgggacaacaggaataaaccaggactgccccagacaaaccaggatatctagtcattttgaccgtaagaatccaaggtttcccaattaaaaaaaacatgtgtttcttactactgtaaagtagccatcaatttttcacagatatattgtgaaaaatgcagccattctttcagttcacagaaagttaattgttctttaagcaaatgtaaacagaaatcatcagattagcagtgtgtctgcagatagaatgaagttccctgcagtgagtgagcaaagagacacagaaacaaaatatttctaatactgtccatcaaaatacctgctacatttgttaatcctaacaaagtaatgatactaataaatacacaccaagacattatactcaatggatgtaatgtacccagagaagtaaagccttttaaatgatgagcactttttctgcttggtttattatactaactctaaaacctttagatatttacaccattattattaaattacctctgtacacataccacgtatcaataaaaacaattcttcacatttcttgaaagattgaaagtatcacactgcacatcttaatagatatgaacattcaagtgaaattgagattttcagaaagattgcgaaaaacagtacacacccacaatgttattctcaagatactgaaaatggtgctcactgacgttacaaaacctattactttttaaaaactcaccatgtctgatttttgtatcacagtatgtaaaacgtacagataaaaatatgacttgtgactctgccaataaacatgatctcttttaacattcatactgtgtctataatttttgttatttgacctagcaaacctaacctccttttccccatcaagtgtactgaattctatttcgtggcaagctcctcctatcataatatccttcctttacctcttttattacatcgccctggccaaacctccaccttcaggttgctctctaccttgaaagaagtccattcagtttcctagcaccttggattccctatccagcccaggccagagttaactatttccaagccaccttcaccactacctaattgtgctgacctcttagacactcatggatgccaatctataatgctagataggccccagagtctacttcttccctgcccactcaggctgcgaataaccactattaaaaaaagaaaaaaaaaaaaaaaaaaggaaagaaagatgaataaacttctctctataaattcatttggtagcaaccgggtactgaggctcatgcctgtaatcctagcactttgggaggccgaggtgagaggatcacttgaggccaggagcttgactggcctgggcaacatggtgaaaccctgtctctactaaaaatacaaaaattagccaggtgtggtggtgcatgtctgtaatgccaacaacttgggaggctgaggcacaagaatcacttgaacctggaaggtggaggttgcactgagccaagattgagccactgcactccagactgggtgacagagcgagaccctgtatcaaaaataaataaataaaattttaaaaatataaaaattagccaggcatggtagtgcacgcctgtaatcccaggaactggggaggctgaggcacaagaatcacttgaacccaggaggcacaggttgaggtgagccgagattacacccctgcactccagcctgagtgacagagccagactctgtctcaaaaatattaaaataaaataaaataaagacataaaatttatttggtagcctcttcatgtttgtatctctaccaaagtaatgtattcaatattctataaataaacaaacaaatgaatagatggctattcaaaacaatctctatgcttcctcatctcattaactttactggaacttaatggtgtaagttttttaacacctaaatacatttttatctcttcaccagtcatcttacccttcctagagtctaagaggaaaattcgatctcctttagtcactcttcctaaaatgtgctactctacctatagttcccatatcttttctgcctcccaaagcactagatattcataatacttgcctttcttctctcatttgcatctacacatgaacaggtaatctctcctttgacacagaaaaaacacagttttgatcatacctcccattctaccttctgctccatctcttccctttcttgaacagataaaagttcttaaatgagtgctccataccagctactcccatctcctcaccttcctagctttaactccctccactctgctgaaactgttctccaaagcatttttggtccccttctctctgaccactctgggaaacagcactgacctcatcttctttcctgaaacctttccttccaccgcattttaatatttttatacacattgatctgcctatttcagcatttccttagctgcttttcctacctctccatgtaggcatacccccaggatgcagtccgtagccttccggctttctctggcaatacttgactcaacgccttgattctgtttctcaactttaaatttccttcctaagatgactgaactctttagctatagttcttaaccttcactctagcaataaggtgctatcacatattagtaatgatttaacatgtgggaataattgatcagttgtactaattattctaattagtgagttagaatatatatttgtgttgctgttaacggataaggaaagataatggaaatgtgaatgagaagtatgtgcacttgtgtgtattgggggagggaacaagaaggaagtgtgtgagccaagctgagagagaagggagtgccaaattcagtggcacatgcctgcaatcccagctactcaggaggctgaggcaggaggaaagcttgagcccaagagttcagggctatagtgtgccatgatcgtgcctgtgaatagccactgcgctccagcctggacaacacaacaagaacatgtatctttagaaaaacttttttaaaaaattattacaactaggagatacctatcaagaatataaatgcatccaactttaactcagctattccactgccaggaatttgtccttcagcaacactagatacttgcaaaaatgaaactttcaaacatcaaagatatctagacaagattctaaaaccttccagagatttaagaaataataaaattaaatgtcatactttttttaaaaaaaggaatcaggatagcataagacttctcaagggtaataagagatgctacagaactgtggaacgaggccttcaaaataattcttgacaattattttgtactttgaattctacatccactaacttccactgtcaaagttaacagtagtaagaaaattcatctttgagaatagttaggaagttaataacatctaaaatggaaaaaaaaataaatagcaatataaacatatttggaaatgtagaggtacatgcttgtaaaactaaaaaaaagacaaaagatgtttctgatgcatagaactcaggggtgatgaaggatgaagcaaagaatgttttcattaatagtctgtcctattgactctgtcaactacgttcatgtataactttatttaaaaacattttaaatgtaaaggcacatgacatcagtatcactccagcactgcttgttacagcaaaagaccacaaacaacctaaatgtttccaataaggaaatggttaaatgaatcatgcaacaactacatggtgtttagtatctgcttatctgaggcagtacaatgcttatatgaacatagaacctcttgaaggatacacaagaaactgataattataagttactgaagaagattcacacttatctgtcgttcatttaacaaatactgaatggccatatactgtgttattttaattcttttcacacactgtttaccattaaaaaaaaatttactattaaaaagttcttcacaatctgtaacacctaagccatgcaaccttttctctcattgctcctcaacaaaaactctgctgtggtcaggccagtgtctcttacaactattattagcctatgtccatctcttggatttcagcctccagccatcacttctgcaaaattcatgccatgtaacatctaaagaacaaagttgactgtgttccactcttttctaagggtcttataatctggccaattaattacataaaccaaattaatatgacttaaaagatgtacaaaatgctctaaagttacaaagaagagagcatctagttggggttctgggattcaatgttgaaaaccaaatatttggcgggggggggggttgtttttgttttttttaaaacaagatcttgctctgtcgcccaggctggagtacagtggcatgatcacagctcactgagctttgaactcctgagctgaagaaatcctcccatctcagcctcccacatagctgagactacaggtgcacaccaccatacctggctaattttttgtagaggtggggttttgccatgttgcccaggcttgaaaactaaatattttgtacagatgatccctgactcacaatggttcgactcacaattttttagctttattatcctgcaaatgtaatacacattcaatagaaatcacactttgaattttgatcttttcccaggctagcaatatgcagtacaatgctgggccacagcaggaagtcattctgtttttcacttttagtatggtattcaataaattacatgagctattaaacactttattataaaataggctttgtgttagatgatttaacccaactgggctaatgttagtgttctgggcatgtttaaggtaggctgggctatgctatgatgtttggtagggtatgtatattaaatatatttttgacatacaatattttaaacttactatgggttgatccagacataaccccatctcaagttcaggagcatctgtattttaacttcctgattttctatttctcttgtcttgaaattagactccagccctaagacaagagatcttaactttcattttttctgagctccccaacccaccattacctacctagcatggtgctagattaactgcaggatttcaataagttcttagtgaatgaaccaaatggaagcctatatacaaaaatgcatttgtattaacaattccattttatccttaccctattttctgtttgatatacatatatattagatagaaaaaatccaaacaaataagagaagacatttgcatggtaacaggatttctgtaccttgaaaattcagctactctactttttccccatctacagtcatacttctgtaactttacatgtagttgatttagaaagatcagtgtggggaaaagcaagagagatcagattgttactgtgtctgtatagaaagaagtagacataggagactccattttattctgtactaagaaaaattcttctgccttgagattctgttaatctatgaccctacccccaacccggtgctctctgaaacatgtgctgtgtcaaactcagggttaaatggattaagggttgtgcaagatgtgctttgttaaacagatgcttgaaggcagcttgctccttaagagtcatcaccactccctaatctcaagtacccagggacacaaacactgcggaaggacccctgcctaggaaagccaggtattgtccaaggtttctccccatgtgatagtctgaaatatggccttgtgggaagggaaagacctgaccgtcccccagcccgacacccgtaaagggtctgtgctgaggaggattagtataagaggaaggcaagcctcttgcagttgagacaagaggaaggcatctgtctcctgcccgtccctgggcaatggaatgtctcagtataaaacccgattgtaggttccatctactgagatagggaaaaaccgccttagggctggaggtgggacgtgcgggcagcaatactgctttgtaaagcattgagatgtttctgtgtatgcatatctaaaagcacagtacttaatcctttaccttgtctatgttgcaaagacctttgttcacgtgtttgtctgctgaccctctccccactattgtcttgtgaccctgacacatccccctctcggagaaacacccatgaatgatcaataaatactaagggaactcagaggctggcgggatcctccatatgctgaacgctggttccctgggtccccttatttctttctctatactttgtatctgtgtctttttcttttccaagtctctcgttccaccttacgagaaacacccacaggtgtggaggggcaacccaccccttcagatcagtgctgtcagaggataacttagggaagaattaagtagtgagaacaattttttttaaagttcttactgatacaaaattttcttcgaaaagaaaaaaaggaaggtaaatccatctgagatgataataccaaggcagatctatttcttaatagaatggctcccctgtatctccatgaaatatcaactgctatttaatattaggcaagacagctcccaaagtgctcttacattttaaagaatcctcaaggtaattttaacgtgtggaccaacatgttgaacatctaaatgtgcaggctcaccaagccaattaaacaatttttcttgtgtttatctttagaagaataaagtgtttaacaagtaaagtatatggataatgacatggaacctataggggattcttagcaattcatgtaaattaactagatcttctggtattaccacttgcaaaggcccttcaaatgtgatcctaccttaacctaagttctttcatacatcaatttaacatacactaagaaactatgtgtctggcattgtggctacaaacgtgaacctagttttactaaatatataactgaaggagacagacatcactcaaaatattccataaataaataaatctcacaaataaattctaacttggaagatacgatacaagctgaacaccaatgatttgtgccttttctgtatgtatgttaaacttcatccagtggacacaaataactatgaaatctgcaaactggagagaactttacaaatcaacgagtccattttcctcattttatagatgaggaaccagagtccaggaaagctatacaaattgctctctttaggaagttaactatataaaccaactgagtattctgttgttaggctactatcactgatttgaccctgtcttaactctctgttcacctgacccagtccccctttaccctacaattctttatagctagttatttgcaaataacacccatcaccccagctccctgcaacctggctccattttaaaaatctattcgcatctcggcctggtgtggtggctcacgcctgtaatcctagcactttaggaggccaagaagtgcggatcacaaggtcaggagttcgagaccagcctgagcaacatggtgaaaccccgtgtctactaaaaatacaaaaattagccgggtttggtggcgctcacctgtaatcccagctactcaggaggctgaggcaggagaatcacttgaacctggcaggcggaggttgcagtgagccgagatcacaccaccgcactccagcctgggtgacagagggagactccgtctcagaaaaaagaaaatctattcatatttcaatttaaaagcccatgaagcttccttccactggccctacccaagtactcttctcagcactatgtcgacctgcacgacaatttaccctgaacttgtatttattttatcccttataattaagcatacactccttaaaggcagaagtagaaaatgcatcaccttatcaccccttacacagtgtctcagtgatttctcgttattctaatgaataaccagtgccagggagaaatcattccatttggggatcactgctctgtgagaatgcctctgaacattcaaaactcatgaagaaaggcaaaagctgaacccggagtcagagaacctatcctttatttcacaaatattcatatagtatttagtacataacagacacagctcaaggcatcttatgaatatccactcattttgtgcagatgaagaaaaggaagcataaaaagataaaataacctaaataatggagccaggatttgaacccagggaatctaactccagattccacacatttaacatctacactatgctgcctcaaagtatgagagaatacaaaattaagcttgatcatctcctaaacaagaactcagaaaaaaaaaaatacctatcataaaggttaaaagattactttctaacttttcata

SEQ ID NO: 678 - DNA, 43272 bp, Homo sapiens
ctgcaactttcacttttgttctgtcaaagattccaaatgatgattgtgagccactgtaacctgaagacatattggatacatttacttatgtgtgttaaattgtgattcttaatgctattttgtggaaaggctggagaagattttttttttttttttgagatggagtcttgctctgtcactcagcctctggggttcaagcaattctcctgcctcagcctcctgagtagctgggattacaggcagttgccaccacacccagctaatttttgaatttttttgtagagacaggcttcactgtgttggccaggttaatctcaaactcctgacttcaggtgacccatccaccttagatttttaaaataaaggttacaggctgggagcagtggctcacacctgtgttctaagcactttgggaggccgaggcaggcagatcggttgagcctaggagttcaagaccagactgggcaacatgacgaaaccctgtctctatacaaaattcaaaaattagctgggtgtggtggcaggcacctgcagtctcggctactcaggagggtgaggttggagaatcacttgagcctgggaggtcgaggatgcagtgagtcatgattacaccactgctctccagtctgggtgacagagcaagactcttgtctcaaaataaataggtacgtacatacctacatacgtactagaatcaagggggttgtttctgagttcattgagttaacgaggaaggtaaattaatcaggaccttcccaagttacccatgtaatattatttaattgtacatgtttaaacaagctcagattacgttgactgtgagtcttaaaacggtaaccacaaacaggttataccaagatccctcacaatgtgtgttgtctgagagaaaaatcttatcattttctttttttccacattcactattgttcctagattatgaaaggtagtcattcactaaacccttctaaaatattccttttttttccaaatatagaattattatattagtaacagtacaggcatgcccataacaaaaaatggaaactaatatagtcaatataattagtaagtttgattcatcacatcccagggtagaatacctcttgaccttcaaaactgcggtcgaccacaattcagattttgagctattcaccagtgagaatgcatggcaatacatgcctaattggcatagttacatgtcattaatttattccttttattcatttaacaaatatttattgaatgtttactatgtgccagacactataatgctgttctaagatagcttatattacttattattgaaattatacttattaaaatggtaataatttgtagagagattaaactttgttttcttgccctccctttctccttctcctcttcctttcttcctttgtttcttttctttctttgcctccttcttttgtgtagccataaacaggagtctactgggtcgtttctgtttgtaaggcacaatctgcctcccaatccccctcccaaaaaaactaacaaaatttagggaaggagctgatttcacatttcttcagagggcctgttagagtgataaaaggcaaaattattttctttacacgaacagtcacagaaccaaaaaggccaaggaagaagccagagagcacatagtatttaattaggagagtttctagtgtcccgaagccacagaagaagcagctgcttaaacattgcttaccctttgactaatggccaaaagcactgaataggagaaggattaacatggataagacttaaataaaagtgatacaatcatcagagcaacaacaaacaaaggcacattaaaaagtaacatgaaatgatgttaagaaagaggtcatggatgcaaaatgataaaatgtttcgttctttggaagtaactctttttttttcttctgttcttagtcatccatctctgtcagagttctcaaataaaaatgcaaaggaaagttagcaccactctaaaacagtgaagggtcagttctctgcttttggatatgtaatttgaatgggaagtgtcctaatgacaattaaacacaattttctaagcacaggaagaggactgataaagtcaagcaatggctgtggcttttcttttgtacttccgttactattaactatatgcaagttaacaaatgctggacagcctgtccagtgagcagggttgctccgttgccaggcttatgttttaagcgacgattgagtgtacacagatctaaacaatcatgtgcaaagtctaagtctctcattttgaattcggaagagagaaccttggtgccccttcttcctgaggaaatttgggaactatagtacaactccctctcaaaaaaaaaatactcctgtaattccatcctaactactgattgctttatatttttgatgtggtgaggagttcagaccccttcttagtgaatgcaatgtttagcacattctttggaatatactgcttgagtctcttggtgcatcagctgaaacttcattttaatatcccgtacgcacttagtagatacttgcctttcctctacattggtgattattcctggcctatcattcagttaagacctatcctccatatacagatttttatatcgttcatcgaaattaagacttgttgcaagtaataaaaactgaactcaagctacctaatacaaatggaatttactattttatataccaaaattctgtgaaaatacaggtgggactggccttagggatacctgatattaggatataaatcctgtcgcctttctctcatgcttttttttcttccctttgtaatcacttctttattatttgtcactgacctcttcatgaatttagaaccacggtcgtcggcactttctaactcatgctttcatagtttcatgaccacagaggaaaagaggctttggaaattctcaaggaatcactgtgactatccacacttgggtcacattttggactcattgcagcagcctgaaggttagatggtatggatgccccagcttaggtcatgagcctgcacttgggaaaaatgaggggaagttatttttaaaatggaaagaagtggaaggcagacattgtatccagttttatatatttatataaacaaaacactgtaagggggaaaatatagacttgaatcagaggagaagagttaaaccaatgtttatatatttctttaggtttgttggaatatatgtgcatgtaattatatcagcaaactacatagtgaagtcagggagacagattagagagataggaagagtgggagggagagaatgtgcaaaacaagcaacagaaagaagagtggggacatcctgagtttgtatgtgaggagaggacagataggagaggtacaaaggaaagggattagaacagagaattagttagaggatggggagataatacaagggagagatagccaggcatggtggtgcgcacctgtagtcccagctgctcgggaggcagaggtgggaggattgcttgagtcggggagatggaggcttcagagagctgtgatcacactactacacttcaacctgtgtgacaaagtgagacctcgtcttaagaaaataaataaaataaaataaatataagggataagtagagagatcatgagagaaaggaacatagagggacacagatgcaagaacagggaaagagaaggggtcagaaaagcgtaatttgtggagagaaaattaaaatgctattattattggtattattgctgcagttgctctcttttgcccattagactattttggcattattggcaggtttaatgtaaaatgagatttgtgagtaacattgatctccaaattataaatgtctttcaataggatatgaacaaatatcatagtaattctcaaagaatattgctatttttaatcaatggagtatacaacatattatattttaaaatcatacaatacttcaaacaccgtgaagagagaacaaagccatatcaaataatgaatgaatggttgtattacggaagtacttgtcctgatagaacacttcaaataccatttggctgctacttctctctgggtttgctttgtatcccatggagatgatctgagcttaagcttttgttagcttcaaagagagctccgttcttgcctcatctctgcagtattgaaaaaacagacccttggttaacaacaggaagccaaactgattttaatattgtgaactctttaccctgatgcaggaaatgttatctgggccatctcagtgggctggggattatagagctggataaggcttcaaaatacaaatgaactccataggtctggtacagctgtaaggtacaggggtagagaatattaggtggtcatcttgataatcatttgtgttatgttaatgcactccaaagtggacttgtttcttctacctgagtgtatatacaaccagtcttttcactattttcagtggttataactcaggaaagagacaacatatcaacatatgaatgtgggtatatccaacgagatctctcttataattttagtccataaataggcataaaaaatgtgttctttcagaaaacacttactggaacctgagataatacaataagtcgaattgctaaaaagagaccccatggatcacaggtctgacctaatatctagttttactaataattttaatggtataggtaatcacatggcatgggtgagccagggagagaggtctttgaccttcagtatagctcgcaaatgctttctttccacataagagcatgcactggacccacaggaaatctctaggtgacatgtgcagtttacattccttgctcaataggagtatttaggtaattaaaatctccatttatattcagatacttgcatagctttttccaggagaccatgcccataaatgcatagatttcaggtttgtttatcataagcagtgctagatagtgagcatttgatagatagggactgtctctaaatgccattaacttgcttgccaggagggtctctcattcatgagtcaaatctcatgtttaataggagatttgactgggctaccttgtttatttccagggagtggtcccttggtgaaaagagagaatgagtggtagacctattatttgaccatattcctcctaaataccttcttggtgatatggatacagagattagcaaaacagtcactgccttcaaatttttttaccatataagatgatgaacacaaaatcaacaccagagataatgtgcctaaacccttaaataacttgtgtgacacagaacaagtatctcaatagacagtaatattttttacgatagtattaacaatgccgtgttaaggtgctataacctggttgaatcttatttggatggtggagtcttagtggacaatggaatttgtacaagttttgagtatacttattctgctgacatttattgagtaacctcccatgtgccagacattatctgacgtgaaatgaaagagaattcctggtttccgtgagtttttagtcttagagaagacacagtcacgtaaataaataattgaaaaatatcataaagtgtttataaaaatctacttgttaagtatgagagtgcagcatacttggcctccagaaatgcagaaagtttcatcaatatacaaattaaatcttgaaggatgagtgaacacttactgggtaaataacaagatgaaagactttaggggaagagaatgagatgggctaagttagcagcatcagtgaacatatggacatgggggtgctgcagattcttaccattggttcccttttggatgttgatctaggaaaatgctggaaaattaggtttgcctcagatgatatattaggccaacaggaatgaatgataataaaaatagctaccaattttgagaaattactatgttccaggtacaatattaggtacacatttttaatattcatgacagattaggaggatgtaacatcttgattttataaataagaatttagttcagcagctagttagatactatgttgggatgtgcctccataactctcttactgcaaacccatccctctccatgaccctgtgtgagctcccctaggcttcgaagcttgcacattgttctcacctgacaggggagcagtgaaacaacactaggaggacaattagtcatcattcagagtgtatatcagtgtgcctctgcgaacacccacaggaaaaaataaatctacgaatagtgagattgctttggaaatacaatatcaaaacaaggtcactgctaccttctctctccattccatcgagattgcagctcctggcacctcttcaacaggaagttgttggccgcctctcccttgaaggttttagtaggagaatgaaaggatcagtattgggtttcagaaagataaattgcttaccaattgatggaaaatggcagcttagagaatctgtggttagagaaaattgtttgaaacttactataatatttcagagatgaagtaataagaagaatctggagtggcaaacatagatcaattgattgaaactaaaactaataagacttgctgtgaccattgaggggacccaagatatcagtttgaatcactacagtgagcagtgaggctacttagatagaaattgccagaaaaagaaaataaatgaacctttggatttactgagtttgtgggggctgaatgctaaagttttttgtttgagttgggggtagcttataggcaggcaggaactggctctgatgcaaacagaggtgatgggatagaagacatggatttgggttctgatgactttgtgagagtgaatgggaaagcacattcaatggcaagaaccttacaaggaggtagggcacaatgtggttaagctataatttttactatatttcttcatttttattggcatccaattattttatatgtactcactatttatttaaacagctttattcatggggtgcctattctgtgcaaggcaatacctttggcaatgacgacatgatgatgagcaaagcctgaatgtttcttactctcctgagtttattgtctagtaagagacaagcatcataagacattacactagtgaatgtataatttgaaactgagataagtgctctcgtgtgaaacatcttatttctaggaaaaaaaaaagtgcaacaaaaaaaagagaaaacccttgtgatatgaaaggtttccgaagaaagtgcagctgtgttaagacctgaaggataagagttgccatctaggcaaaaggtgatgaaagtaaaggattctccagactgatggaaaagttataacaagagattggagtgtttaggaagttaaaagaacatgtaattgaagctcaggagggggaagagagatgagagatgtgtgtagagtccagagcactcagaatttgcagaataataaggattttgatccatgttctgagtaatgacatgccattgaaggtttccattttttaaaaatattaacccagatctcctttacatgagcaatacagataggaagtgctgaggaatcaaagtagaggtagaagggattcagaccccagagtgtctacattaggagggagctgaacctcatcaagttctttccataggattttcttcatgcacaaatatgcatggctggcttagtctgcagaccacatttttggttcacctagtgtttcagatggcagatgacataactctgagtaaattagaagttctggctgtaccaaaaatatatacatcaggaaaatgaaaaaggaaactgttctgtgctgcttaagagaattcattgccaacctcctactggctgttctgacccaataaacaagcaaaagtgacttgttagagccagcagctatattttgagtaccattatccccactgaataattcaacacttaatggtggtgattttggttgctcagagaaggtattcttttgcaattgtgtagctctttgttgagattcagcattgtctagttaacagtatgagaagcaaagcagaattcttgctgtgaaaatcactacttctaaagagatgcggcattgccatatagtagttacattgtgcaattactacatggaaattacttgctgtcttgtagtctttttccggaaagaagacactcttttttattattattatactttaagttctgggttacatgtacagaacatgcagttttgatatataggaatacacatgccgtggtggtttgctgcacccatcaacccatcacctacattagctatttctcctaatggtatccctccccagcaccgcaccgccaacaggccctggtgtgtgatgttcccctccctttatccatgtgttctccttgttcaactcccacttatgcgtgagaatatgtggtgcatggttttctgatcttgtgatagcttgctgagaatgatggtttccagctttatccatgtccctgcaaaggacaagaactcatcctttttatggttgcatagtattccatggtgtatatgtgccacattttcttaatccagtctatcactgatggacatttgggttggttccaagtctttgctattgtgaattgtgccacaataaacatacatgtgcatgtgtctatcgtagaatgatttataattctttgggtatatgcccagtaatgggattgctgggtcaaatggtatttctagttctgcatccttaaggaattgccacactgtcttccacaatggttgaactaatttacactcccaccaacagtgtaaaagcattcctatttttccacaaactctccagcatctgttgtttcctgactttttaaagatggcaattctaactggcatgagatggcatctcattgtggttttgatttgcatttctctaatgaccagtgatgatgagcattttttcatatgtctgttggctgcataaatgtcttcttttgagaaatgtctgttcatatcctttgcccatttgttgatcaggttgtttctttttttcttgtaaatttgtttaagttctttgtagattctggataggtcttcgtcagatggataaattgcaaaaattttctcccaatctgtaggttgcctgttcactctgatgatagtttcttttgctgtgaagaagctctttagtttaattagatcccatttgtcagtgttggcttttgttgccattgcttttagtgttttagacatgaattctttgcccatacctatgttctgaatggtattgcccaggttttcttctagagtttttatggtctaggtcttacgtttaagtctttgacctatcttgagttgatttttgtgtaaggtgtaaggaaggggtccagtttcagttttctgcatatggctaccagttttaccaacaccatttattaaatagggaatctttttcccattgctagtgtgtgtcaggtttgtcaaaaatcagttggttgtagctgcgtggtgttatttctgaggcctccattctgttccactggtctatatatctgttttggtaccagtaccatgctgttttggttactgtagacttgtagtgtagtttgaagttaggtagcgtgatgcctctagctttgttcttcttgcccaggattgttttggatatgcaggctcttttttggttccatatgaagtttaaagtaatttttttccaattctgtgaagaaagtcactggtagcttgatggggatagcattgaatctatacattattttgagcagtatggccattttcacaatattgattcttcctatccatgagcatggaatgcttttctatttgtgtcttctcttgtttccttgagcagtggtttgtagttcttgaagaggcccttcacatcccttgtaagttgtattcctaggcattttattatctcagtagcaattgtgaatgggagttcactcatgatttggctctctgtttgttattggtggataggaatgcttgtgatttttgcacgttgattttgtatcctgaggctttgctgaagttgcttatcagcttaaggagattttgggctgagaagatggggttttctaattatacaatcatgtcaactccaaacagagacaatttgacttcctatttgaatacactttatttctttctcttgcctgattgccctggccggaacttccaatactatgttgaataggagtggtgagagagggcatccttgtcttgtgctggttttcaaagggaatgcttccagtttttgcccattcagtatgatattggttgtgggtttgccataaatagctcttattattttgagatgtgttccattgatacctagtttattgagagattttagcatgaaggggtgttatattttatcaaaggccttttctgtatctattgagataatcatgtggcttttgtcattggttctgtttgtgtgatggattgcatgtattgatttgcatatgttgaaccagccttgcatcccaggtacgaagccaacttcgtacctggtggtaagctttttgatgtgctgctttttgatgtgctgctggattccatttgctagtattttattgaggattttcacatcaatgttcatcagggatattggcctgaatttttgttgttgttgttgtgtttctgccaggttttggtatcaggatgatgctggcctcataaaatgagttagggaggattccctcttttcctgttgtttggaatagtttcagaaggaatggtaccagctcttctttgtacctctggtagaatacggctgtgaatccatctggtcctgggctttattggctggtagattattgattacttcctcgatttcagaacttgttattgttttattcggggatttgacttcttcctggcttagacttgggagggtgtatgtgtccaggaatttatccatttcttctagattttctagtttatttgcatagaggtgtttatagtatcctctgatggtagtttgtatttctgtgggattggtggtgatatcccctttatcattttttactgcatctatttgattcttctctcttttcttctttattagtctggctagcggtctaactattttgttgagtttttcaataaaccagctcctggtttcattgattttttgaagggtttttcgtgtctctatctccttcagttctgctctgatcttagctatttcatgtcttttgctagcttttgaatttgtttgctgtttcttctctagttcttttaattgtgatgttagggtgtcaattttagatctttcctgctttctcttgtgggcatttagtgctataaatttccctctaaacactgctttaaatggaaagaagacactccttaaatgacttggtgggagcttttattttatcaatttctctctgataaattatactggtagtcatatctggtcacggataaactttatttcgtttttgactgtcaggcatgttgaattcaaattgcatgccaaaccataacatttaggaaaacatcatatctctagagttataattgatttgtgctaatgatatgttagtagaaaagaatgacagtttgatttctttcattcaaaggaaaatctctacagtaaggaagaaagtatcatggctaaaagtcacttttatttaatctcaggttttatcaaaatatttacagaacactttgtctttgtcacctgctagtcattcagtatatttcaatgacgacagtattatctttggaatcacaaaaatatgatgtaaaagaaaacttttctagagtagagtgaatgcttaaaaatataatatatatccaataaatgaattacagttaggaatgttgacatgattaagaacgcttgcattactgatagtgacctctgccctattataactttatagctaaaaagtttaagatctttcacagtttctccttcagtaatcctttttccaaactgaatttcgagtgcctagtaacttgtgatttttctaggaaaaacccatggtctttacctgtttgttctatagataacaccctataacttgcttttttcacttaacaaaaaataatagatatatcatttatataacagatataaggcatactatacattatatataatataaatgtacatataaataaaaataaatataaatgtctggaagtgttcatatcttaaatgttttctggcagggatggggagaagagggttgtataatcttcaaatttttactgaatacgttcctttgccattattttctgttacaataagaatatattttattgtaaaataagtaaaaacaaattaattaaaaatggtacgtgatgataaaaacagtagttcttagaaatattatcaatattggaatcaaaacacataagactattaaacatgtgtatttaagtaaactgcacattatatccagaaaattgaatctaactggttatcatgcaaatgaagaaggtaatcagttcaaaaatgacatagtaactgatattgccttcctgttcttatttcttattcatggaaaacgaggacaagatatgaagggtttagggatctaggtcattggcccgggatttggcattaattcttctcatacaagcacagggaacgatcaatcagtgttgacagctctaatgccatcgttggagcagaagatgagccaaaggaaattatgagtttcttataaatgtgtcttaagtatctggaaatcatactttgtatcttatggcttgaatagaatacgtttgcttttaatgatttgtacagtgagaagattaaaatttctaccaacatatccaaagcactgatacatctattaaactgtttgcaacaaaaatacctatacctttttgaatttgaataaaaaatcccatttaaacaaccactgggatgtgattatgccccaaatctctctgattatagttggtttgctttattatattccacttgaaaattttgaattgacaagagggatgtttctgtgaactacagattttagaggaaaataagactaaagttttttgtatcactgtttggtgtttagcatttttcaaccagtaaattgtctttaaccaaaaaatttgtctcagagaatggaaaaagaaatgtgatgacaaaaaaaataatgcaaaaaataaacagttatgaaacagtatagagataaaaaaatcaaaggtgagatatcccaaaccatgaactatttatcttaatcatgcagccttttcatctctgaaagaatctattaatgtcatattcaaatgcttaatgttcactagcagttgataattatgatgaccatccctgtcactacaagatccttaagtgccttttgatgagcaaagaaaaataaaatcatattcaagtaccaactgttggaattcgtactttaaatacaacctgagaaatggccttaggttaaggctaatggtgtataacttgctcacatttctaaagagtatattttctgacaatgattccatatagaaagtttaccgcagataatagtttcttcatatttgcatcctgacctaatttttggtcattaggttactttttataggtatcaatattttccaagtcctagagaaaaatgagagttttaattttctcttataacctagctaccagatgctatgtggcaaggacagtcttaggatgaaattgtccagacaaacaaatatgtattagccatcaaatgtacacatatgctcataagtatgtgtacacatgcacaagcatgcatttacacacacaaacgtacacttcacagaattataccctgtattctgtcagcttgatggagtcccagctgttaaacctttgaggcattgtgacagaaatctgcaagaaagcttcactagaggcagatgagataatattctagctgcaggattcagctacattttcgattggagtcataggaaaaaacactcattgcaaaaatgaatgaaatcctaagcctggagtgcaatgaaattgtgtttaggctgtggggctcccttgattttttaatatcctattcactcaaggatgcttgtgtctgagcaaacatttctagcaaatccaccaatatatacaacactacttgtttttttttaatggaacattctgctaacatcgactatagtgattaagccatacttacacacttaacatactttacgaaataaagatacctgaagtacatgtagtaaccagtgctgctacatttgactagagatttagaagagttttgtttaagaccttttgaatattgactgactatacttatggggtacattaaaattcagtagcctctacattaccacacagcctatgctaaagtattttaaagtaaatttcagaaaagttaatgatttgtttttgttgacacttttaagaaccactaaaacctatgaatatggttggccttaagtagacactgtaaaatgaatgaggttgagagatattcatttaaagttctattagcctttatggaattattgtgagaagcccagcaatgttcagctcagtgttttacattcagatccatatttactttaacgagtatttcagaaagtttaatttctgagttgtctttggatgaatgagaaaataaaaggaattcagaattttatcaaccgtctatatctatgcagattatattcttttgtggacatatgtatgaaattcattcgttcatccagaaggatttattatgtgtatttcctatattctaggcaagcgcaaaaataatgaataggatctggcaactgcctcataaaatgtacagtctcctacaaatatgtagacaaggcaggtacaaaaaattgtgagcccttgtttattttagttttataagtaatgtgctcactactgatatccacctgaacaatttgattaacacaaaaaactggagaagtagattaaaaccatccaaaacattgggagatatagatagacagctgatagatagatagataatcatataaacatagatagtcatataaacatagggagattatatatatagataatatctatattatagaacatatatatgttataataatatgcaatgatatctatattatataatatatatactagaatgataaacaccgttattaggtgagctgagacaggaaggaggcgcgttggtttgcctctccagaccttgatctggctcagatggagctccagttccttgcactctagcacgtgtagccctctgctcagcacggccccatccttatgcgatgcacgacagaagctcgccctgctggaactgctcctccagaagactgctgtttgcggcattcattttcctttcattatatttttttctgaatttgttctggatcgttttttgtttaaaatctcttcctcctcaggagtccgctgggcccccttcttgtggcccggacggtgcacagtggagctcgcactgctgttgccaaggtgcgcggccggcagctcctcgccagggccccggtgcaggccggctggctgtgggtcacacgcagacaagatcagcgaccctcgttttgcgagtgcaacactcccagccacagaagttcccgggtccagcctcagagcccagtatttcccacggcctccccacacacaccccgcgtggatgcggcgagggcccgccttagtcctggcagtgcgcaccccagctcagactcccgcttcttgtggcagctccttctcttgcccctgtgccttctgctgcttgtgccagttgtcgtgagagatgcccggtgctgggcgctggttggaaagaaaaacttaggtatatattttctttttctttccttccttccttccttcctccttccttccttgctttctctcttttcttcctctttctttctctttctttcttttctctttctttctttcttattccttctctctctctctctttctttctttttctccttcctcttccttccttctttccttccttccttcctttttttgaaacggtctcactctgttgcccaggcagaatcatagctcactctagcccgaaactctggggctcaagcaatcctccaaccttggcctcctgagaagctgggagtataggcacgtaccctatgccttgctaatttaaaaaaagaaaatctttgtagagatggggcctcactatgttgcccaaactggtcttgaactcctggccttaggtgatcctccagcctcagtttctcaaagtgctaggaatacaagcatgaggcactgcacttgatcctatgtttttctaattagttttctacttttaaatgtaactgtaagttgtaatcaaacattatatatattatcctttaaaaaattctgaatttattgttatggttaaatttttatcattagtttccagactcaatgagagtcatttttctattaatggaaaataagggacagacctttcagcttacctggaagtgcctcatttcttttttgaaaattcctgccatggtactgatcaatgttgatatatatgtgaaaaaaataaagaggagacaaacagaggggatggtatttaataacaagagaatagtagagaaggagagaagacagttttaaaaatgagcattcatgggttgggcacagtggctagcactttgggaggtcgaggtgggaggatcatttaaggccaggagtttgggaacagcctggacagcatagtgagacccctatctctataattttttttttaattagctgcatgtggtggcggatgcctatagtatcccagctactagagaggctgaggcaggatgctcacttgagccaagagtttaagactgagtgatttcaccactgctgttatcagtctgctgtgattttaggtgtccaaggtgggagtgagtgatgaaaatctgaaaaagaattaagaggatgttctctttaatttacaaatatatttttgaagttgattttttgttatagcttagaaatctgtcatatattattattgcttcctctcacatattgcagtttttctttccaggaagatttcattttttagtgttgttttaggttcacagcaaaattgggcagaacgtgcagaaatttctctcatactaccggttctgcatatgcacagcctctccgttatcaacaccaccagcagtgtgcatttgttacaactgatgaacctacattgacatatcaataacgccccaaatctatagtttacattcgggtttcttttggtgtatacattctacgggttttgacaaaggtatagtgacacatatccacaattgtagtatcatacaaagtagtttcactgccgtaaaaatcctgtcctcctattcattccctcttctcccttaacccctcacaaccacttatctttttactttctcaatagttttgccttttccagagtgtcgtgtagttagaatcaaacagtatctggtgttttcaaattggcctgttcacttaatgtgcctttaggtttccttcacctcttttcatggctgatagctcatttctttttaccactgatattccattgtctggacacagtatagtttatttatccatttacctaccaaagaatatcttggtgactttcaaattttgataaatataaataaagctgttaaacatccatgtacaagttttttgtggacataagttttcaactcctttgggtaaaaaccaaagagttcaatggctggatcacatgtgagagtttgtttagttttgggggaagccatcaaactgtactccattgtgactgcttcaatagtaatgcatatactatatccacaatttattgaccacacaacttttttttttttttttttacccagcatactatagcatcagtatctgtcacagtgagggtttgcacttttcaggtagggctgttcttccttgggcaggactgtgctgagccctgcaggtcgtttattatccacggctcctgcccactggatgcaaatagcactgcccagtcatgtgacaaccccagctgctcccacataatccaaatatcacctggaggagagatagcaccttggttgtaatccaaaaggctagaggaacacaaacaggtcttaccctcttatgagctggccatgtgggatgctccaggagtgaagctagtggaatgtttttagtgactgaaagtccttaagaaatgtgaaaagtggttacctggatttatacatatgtaaaagtttgctgagctgtacacttaagttttgtgcattttagtacatctgagatttttatttaatttgaaaaatagtccctacaggaatttcacagctatataagttgttttctgagaaataactcagaaaataacttaatgttgggattattctccatccctgtagtcaaatgaccatgaatttccgtaattttctttcttagtctccactgtgaaacaatttgaattagatgtcattacagtatactattttttaagaatcttacatgtataggtgggaaaacaaaaacatgtatatacataagtttttatataacctgtatgtatatataggttatattcaattatattccagttagagttcaaccacagtaatttgctatttaaataaatgatattattaatgatattagtttatcccacatcattattaactaaagctgacattttcccaataaaatcaatttgcttataataacatcgacattcctttgatctactgtgtacaaaatgtgccagctctgcagggatgatgagttaacactctaagcagttcttttgtcgtgtcactgcggtgttatgagacatgaaagagtgtttgaatggatatggctataatgcacagtgtttcctttgttttcagagtaaaagccattaacagttatttcaggattactgtgtttatgacacttgtaaattgatttatggtattagccaggcaggtgattgaacaaaagccttttaatgtttgtgtatgtgtttatccttctcagcttcacaatgttgagtgattcagatcacacttcaggcttatggaaatttgctggacctcctccccataagaactgattccaaaccaggggaatagtttaacctagcctgataatcacataaaaaggagtttcataaagggacacttgaggtcagagagaagtgaaggtgacatccactccatcatgaaaatgtcaaatggctttatataagacatcttgcttgatgcagctcagtgattcttaagccattttatcatggagagaaaagaaaatttaaacatttccgagttatagcactgtctcagactattatacaaatccattgagttatttttaaaactataatttggatgccagtgtcataaaatatctcttcctgctggctataataaaagttgttgatctatttcaagcatcctgagtagaaaaatgttgtttaatgattttgcatgcatgaagttaatttctacctctggaactcatagtagctgaaacaacttaatgctgtttcttagtgaagaggaatgtcaacgtagcatgcttttttttcccttcttttttggctgtgtgcattccatgttgtcaatgaaaatggcagatggactgtcactgacatttctgctttgtgtagttgctgccatagaaatgaaaaagtttttaaaatggtgacgataagagtcaccttttgttcactgaatttgctgtgttatattttcttcttggaaatttgacctaaaactgtttgtgaataattattcagaaaaaatgtcaaggatttttaaaaatcactaaaataaaatgtgctatgtcaaaccagctgcctttctaagctgctttttgcccatgtatcacactcatcagattctatttccctctaggataaagtagaaacctctttttttaaattccagcatataaatttgaataatgttatttgcaaaagggaaaatcgaagcatttactattcattagagccattagagaaccatagtgccaaaggttttgtgtaaacatgacatcatgactgttaggtgaaaaaaacaagtgattattaggaaatgattattattcagagtacattaacaatagccttgggtctttaaagtaattttaaaataatttgttttagtgttcagtttataatggtggaatgatctataattgtccaaagtgaaaacttagtcttaaccatttgtatgcattgttgcctttctatgctttattattggaatttaaacagtctccagtggaaacataatgcaaagttggtgaattaaggatcaaagcattaaagaaaaatgaacaggcatcatgtatactaacagctaccaagacttaaatgatggtgtactataaaatgggcttacattttctttaggtgggctataactttcaaaactcttaaaccaagaaagaaaaagcaatgagttacattagttgcttaaactaaatatgcagaacatacacactgatgtttaaagaaaccccacattttctcatcttgttccaatagaagaggtgcagacagtatggtagctttaagaaagtctttttttctgtttgttttttatttttattttagatgtatggcagcaggcattctcaagattttgtctaccttttgcctaaagaatctccttactgctgttgaaatattttaggctgatttctgatttccaaagactgaataaacattaaaaatgtttccattaggaaaatgttaaaatgcacccccaatagaaagattagcataacctccccccaatcttgcactctctctctttctctctctctctctatgtgtatatatatatatatatatatatatatatatatatatatatctgcttcagcaatattcattattgcatcaatttgtttattctatctcttctacctaaattagctatttctaccttgaaaaccatcccaaaacactgattcaataaaggaaacatttattattgttcctaagtctactgtttctttgggagattctgctgaacttagccagtcttgactgatactgaccagctggttctagcatctgtgttcagctgacaggttagtagggcagtctcatctaggatggctgccattttacgtttagtggctggctggctgttggccaggatgatggggatgatgggcaaaatgtctcttatcttccaacagggtagtgcaggcttctttttaaaatagctgagcagagttttcagagacagagagaaagaggaaaaaggtgcaaggcttcttgaggcctagactagaattcatcctagggtcaaaagcctaccagattcaagaagtgaggaaatagcttcttaggaggagctacaaagtcttattacagagagtgtgaccacaaagaggggaagagaatcagagaagattttgcaatcaatctactacactctcacacttttggggagagtattttatatcaatcaatatcatttcaccactatatactttagagaatttgcctttattttgtaagttgttatgattttgtaactctaatagcatccacaaagttaaccatgctccttggatcagaatattagtaggagggactatatcctcattgccactatcaacacaatgatcatcactttcactagtattagcaaattttatttatttttctctgctaatgacacattacctcacttaaatctcataagtgtgctatacagcagcaactatcaccccagtttgtacagctgagtgagcaggctgggtaaactgcccacagccatctagcaatggtggctttgaacccaggtcatactaactttcccatggtctcatcactgcacatcactttgtcatgtgaccagtcaggaggccacagtagctttgcacttacttgggaggccaagtagaatggacaaagacttagccatctctctcctccatttctcaaggaataatatgaatttaaattaagggagcaagttgtttctagatttgccaccatggagcacttttaaaaacatcaaggggatctatgtggtcactttataatactcatgatgtgtatgttagaggcttctgttttgaagaggcaaagaattttatttcctttttgttgtgttggaagttgccctaggaggtacgcacgcttgtccatgttaaactaatgtcttgaaatcagtgtattcttaattcttatcccactagtcgtactggagaacctgagggagtcaggaaggttccattgcattgaagcgactgcattgtctggggtaaatacctggggttcattgtctcatgtcaagaaaatttagaacatggacacatatgaggagtttagaagcagaggtttaataggcaaaagaaagagaaagaaagataaaggaaaacaactctctctctagtgagagagaggggcttcccagaggaaaaggctggcctgctgcggatgcactatattttatagacaggcttgaggaggtggtgtctgatttatgcagggcccacagattggttcgatcaggtgtgacgtttacatagtgtgcagaaaaggcttgccaccctactcttattaccctaatcttatgtgaatgggctttccagttgaccggtgccatcttgtctgctccttactgtacatgtggctgggaagggaagatggagccaccatttttgaacatgattggcacaactgccagggtctatgtctgcagctctattttacaggttgctctttgttagaaaataatttgggggctgcatttcattgaaaaggaaaaccttaccgaggactctagtaccctcactatctgcctaagtaatttcttcttaactcctatgtcagtaagatgtgacagtaagatatgtattatgttggtgcaaaagttattgtggcttttgatggcaaaaaccacaataacttttgcaccaagctaaatttttcttttgaagtggttggcagggatgttttttttcctaaggatgagctacgatcgtaggaattaaaatttaacccagtttacccagattcataaaaattaatagatttctttgtggatctgagttgatatcattaatataagctatcagacatcagcttcatgtgacttaacttcaaaaatattttagtaagagtatgactggaatgtttataacacaaagaaatgataaatgcttcaggtgatggataccccaattaccctgatgtaattattccacattgtatgcctgtatcaaaacatctcatgtaccctataaatactagatactcatagaaagtaaaaattttaaaaaaattagttcttgtcttagtgccagctccatcctgagtttcaacaattgctattatctttgaggtctagcatgaggcattaaatgccattgtttcaagaaagataaatgggaatataattttattgctatcttactgttgcaaaatggaattcctaagaaacataccctttatgaattctggcaatgaaactaagactgactttccgttttcaatctgaaagctattttggagctttcatcgtcagctaatggagtcttacttgaacggggtcacatttaaacttctaataatttttatgttgtagcctgtgaacatacaaatttcaggtaaattgaagctaattcctgcaggaggtaaggtcatatgtagaattagtcattattcatattctgaaaagtgatgatgtcattatgggagagaatttcttgggtcaagaccatgcatttaaaacgattaaaattcaaaaaatgggatcaccattactgaataattagtatctataagctactttactaaaattagagaccagtgaacttactgccctaagtcaagagattaatggaaattgagagtgttctcacttatttggctatctagttattcttgttccctatttcagaggtgagatgatgttaaatattaatctggaaatacgatctcctagtagcataatacttgggaaagtcttgctccttacaaataaaaggcaactcataaaacacatacatgagatgctcttaaagccatcagcattgaaaactaatggaaccgagtattaaataataactagattgcaagtaaagattgatatataataaacaatgactttagatgactattaccaaactgtttcagaaaaaaaaaaaaacaggaaaaagaaaattcgaaggggcagggcattgatattttcctcaaaattttcatattaataatagctacatggtttaatgtctcccaactttgtacaaatacgtaggactcaccttttgtagttaaggcagtattttgctttttataatgaaagcatttttccatgttttatttcattgattaggataactcatttcatcagaagagtagtgtcaattaacatagtgacacattgaacatatatgttaaatttaccagtagaagttaaattacaagtataagttatttgtcattagaaaatattctgaagcatacatgagtcattttttccaattcccattttaagatgggtcagttgaggtcagccagagtagaataatgccattactctaattcaggacaaagattcacaacttttttggaggtgggagggtagtattttcttttatgattaatataattttgttctcaaagtaaagcataaacagtgttgctgttccttaagactgctaaaactgtgaaacaacagccattagttactactttaaattttaccaatcggtacatatatacaaaagatacaggtctataatatcttaagatgcaatttaaagtgaaataataaagcggaaatacttagaatttaatgtaagtttaaagactttactatctctgtgttagctaacttttttcaccagttctaagtgaacacatagagtaattgatttttagaaaacaaaacaaaattacatacctgaaagactaattctcacattttggagcaaattattgtattattacctgcaagaatacatgatagacaatgtataaacaatgtttagacatctattaacacaatgtttcagaaaaaaattgaaattgtaagagaaagtaaaaaaaattaaaaccttaattcttattctatttctgtaaactttgaaatgaataaatattctgtttaaatgagaagcatcttacgcctttgtcttctgcttgaaccaaactcacatttgtaaatttcagttaaaatggtggcctttattcttttgttctttattatttctttcctctatcttgctggaactatccatcttctattagtgtgaaaactttgaagatgaaaagctatttcaccggaaaaatcattgatgtatttgtgatccttaataatgactcaaatgggaatagatatctaatatgaggaactgagtaaaaaagaaccactttttaaataaaattaactaaatgaagttattgtcttagccattaacactcatcagtcatatacaccatggaatactacacagccatataaagaacaaaattgtgtccttgcagcaacatggatgcacctggaggtcattattctaagcaaattaactcaggaccagaaaaccaaataccacatgttctcatttagaagtggaagtccaacactgaatacacacggacataaagataagaataatagaatattatggacataaagataagaataatagaatattatggacataaagataagaataatagaataattgtggactactagatgggggagggtaagaaggagtgaggattgaaaaactacctatcgggtgctatgctcattacctgagtgatggaatcatgtatacaccaagattcagtggcactcaatttacctatgtaacaaacctgcaaagttacctcctgaatctaaaatagaagttgagaataaaaaagaaaaaccactcatgtgtataatatcataccttccaagtaaaacttcctctgacttaggattttttggaatagtctgtggtttacaatagagtatatattcgctgtcctttattttacatacaaagaggaaaaactaatttcattcatgcggagttatgagagaacagtttcataaggaggaaacatactgccaaaccaaaaaaaaaaaaaaaaaaagaaggtatttaatttgttctgttgaaattttagagtttgtgaactaacatgttattctgtttgtgtttttagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcaggtaaagttaaaacattcagtgcctattaatggaatttcatatttgcattttgatttttaagtagaatacttatggattgaggatgtgacttttctaccatatttctatatattctttagcaatctgtcatgagaattcatatctatctttttcgttttgtgggtggctgatacatgactgctgtaattattttgcaacccaggcttttagttccttatgcaaacttagaacataacaagaatagtaacctatagataagctagtatttttccatatgtcttggattatctgcaatattaccaacaacttcacttttgtatacttaggttagttaatcaagattcagaaattactggcattcaacaaattatgtcgaaaaggaattggatgaactttgtattctttttcaaaatgattatatttaagaatgaaaacaatgaattagcaaaacaataagccattttacaagtaaaagtataagatgatatgaactctcaaaatttacggcattatatagtgtgaattcatattaagaggttaaacagtagtctgatggaaatatataaatatatattctaacatatattggtaaaatggatgcagatttttagccattataaatcagtttgaacgaaccatggtaattaatagttaaaaaaatagatcagcatcagcaggacatggtgacacatgactgtagtcccacctatttaggagtctgaggcaggaggattgcctgagcccaggagttcaagactatagtgtgcaatgatcacacctgcgaatagacattgcacgccaacctggacaatatagtgagactttgtttttttaaaaaaataaaaactaaaaaaatctgcaaacagaacatatgtaatagtatatcaagtctgccatgtatagatcttgcagatttttcttgtattacatgcatatgggttctaaaagacccacgagaggttattaagacatttttatccgtatcattcaggaataatctctattgcatcttctgtatataatttggagggttattatattagaggtgttggttgtttattagaattttagcattgcaggtgatatttgtggattttctaaattctagagaaataatcttgagctcataaaatttaatacatcttagaaaagtgttgggacttaactaaaacgttgcttttgaagtgctcagacagactgaatgtcaatagaaaggaaacaactctctgactatctataatataatgtatttaaaaactattctaagggccaccttaaattacttgatgtacctattttatattatgcactttggaaagaactgaaattgtagttccatccccccaggtagaaatcccttctctattatttttaacagataagtaagctctgttttgacatttccatttcttaagaaattccacttatctgacctacaaatatacagacttaaagtctgctttacatttggctgaaatctttcggcctacacaatgtattagatttcttcactgaccagcctttttgtagaaattctggtcgggagtctaaagtaccttcatctttagtgaattcttttgctttgagtatgcagtagcaagttaagagcaagcttcttggtaatcctgtggaaaaatgttaataatttcacattgtcttccgaatagcaacgaagatgccactgagattactgattcagatttttgaccataatctctggcatacacatttattcttcatcatttcttactttgtcagtggtgaaggatgtgaaattttgtattaattcctggcccacatttttattctggttgtctcagttacttatgcattttcatgctgtaaggtccttagacaacaattgttataaaatattaatggcatattttcagaacatctgaatattattcatttatttcagggctctagagcactcacaaataaatgcaactaaggcagatatccaatttgaatgtcaaggagtctggtgtctctgtaattggcttaattatagaggaaaggatttataatgtagaatatatattcttataaacacccaaaggttattagctccgttccccaaataattagttattgctgagcctttacaaccttagcaaatttaggaaagaataatgttctaataaacaagttgttcacaagttattagctgatatctaagggactgtggccactgtgtatcatccctcaccgtttataactgcaataaaatttaaataatatgaatttgcaataagctcaagtcctgctctacacagaaatagtagtagtcagaaacaaagtaaatgtgaatgaaaatacagacattttgcatgttggtttatgaatatccagtagataaacactgaacttgagctaatatccataacctggtaaaactcacttatcagatttatcgggcaataatgaaaaattaaaaaaatagaattaatagaaaaaaattagagtttggaaaggcatttagtttttattctactctggctgtcaatgctcaaaatgtggtttccagaattcttggggtcccagggacacatccagatggtctgtgagattaaactgtttttatcataaacctaagacgccattttttcattttcactgcgttgtcatttgctctgatgatacaaaagtaatgagggctgggcgtggtgtctcatgcctgtaattgcggcactttgggaggcttgaggtcaggagttcaagaccagcctggcaaatgtaatgagacctcatctctaaattatatatatatataaaatatatatatatatatatatatataattatatatatatatataaaacgaatagctgggtgtggtggcttatacctgtagtcctagctacttgggaggctgaggcagtaggatcatttgagcccaggaggttgaggctgcagtgagccatgatcatgccactacattccagcctggcactggcatcaaatttactggtagtcaggtgatatttaatgtccatatactcagagtaaaaaactctcaaaacaaagcaaaacaaaaacagttttgcttatgattataattgttgaagcacttaaaaattattaatgttattaattatctaccttggaatacatactttctaacattctagtgaactgggaagtagatataaaataattctgctatgcgtcaaagtattatgacaatctctatttcttaattgcatcattgcttgagtcctgagctggacatcatctttactttaaagttatgactgacaaattatggttgttcagatagatataggtcagatattttcctgaaagtgaaccaagtgagcccattcatttcaagataaacaactgaccatatataaggtcattgattaaatgtgagtgttcaagaaaacattagaattgtggaggacatgtattgtccactgtaagcttgagagcttcccgatacttaatactgctgattagatcagtggcaattctaacaagtgtcaatttttgatattctataatgaaatgcatcaatgtttggaagacacaaaattcagtgagcgggtattttttccaaatgaaagctccatgatgttacaaaatcatttgtagattaaaaaaagtaaaatggtttaatggtacacagtatgaaaagttgattgatagggtttagatttcacatttcaatgaatgtttaaaaaactacacttgtatctacaatcatcagaaaggactctaaaatttcccatcattttttaactacgttatctgtgtacggctggattttctttatatctttgaacaaatcaaccctatttcaacagatgaaatgcagaagcagataaaagaatccatctgccttctcaagaaattgcagagatggcctttagttctagccactcgaaaggctgaggcgggaggattacttgagcttgggatttctaggctgcagtgagcaatgatcctgccactgcactgcagcctgcatgagtgagcaagaccctgactcaaagaattaagaaaaaagcaattacagagatttgcaatcatgtaaagtaatgcccttcttctcataatatttaaaggttttcataaaatatgtgatttactttaacattgaattattttaaataaattcataagtaaacattttgaaagacattttgaaagactttttcagtttttattcctgttatagtaaatattgttagctataccccacatgaacaaatgctctttgagatgtcttgtaatttgtaagactgcaaaagagtcctgagaccaacacgttgagaacaatttatctaggctaaatccttaatattacaaatgagaaaacagagagtggttcagggcctggtccaatgtcacaggttttagggcctcatttgcaactctactgtggaatagtacttatttaagttaggctctgtgcctgtctccaaattgcttttctcatactttatttgccaaagtcaggtccctgctgcgaaacagttttcatttccttgtgaatcaaccctgtctttttattagagattctaagaactgtactaaaactgggatgtctccttttgaaaaatattgagtgctcatcagcagtagatctttacacacttcatgatctatgttttatttcaaagcttaatccaagttgtatttccagcattagtaaatttattttatagttgtaattctcagaaatgtaatctcgctgctctactaggtgagaggcaaaatcacttcctactttatttatttatttatttatttatttatttatttatttatttttacttttatgaaagagtctcactctgtcacccaggctcaagcgcagtggcttgatcacacctcacaacagcttcaacctcctggtctcaaaattaatccagttaatttttacatttttttgtagggataagagtctccctatgttacccaggttgttcttgaactcctgggcttaagtgaccttcccacctcagccacccaaagtgttgggattacaggtgtgaggcaccaagtgtggcccactccctactttttaaaattgtgtttgtcttgtagattacttatcaaacactaacagagtttgtcacaagaggaggggatatttgaatatgaagaatctattaatgccattatgcatcagttattattatataataatggttattagtaagttaaattctctaaggaaacagaacaaaacttccaatagataagtgagaaaaggttataaaatgaaaacataaatgaggaataacaaacactaaacaagcccatgaaagaacatttattacccaaaaaaaaaaagaaaattaaaataaagggaataaggagtttatattttcctttgtaataaatgctaaactattttattattttgaaatgttagcattcactggtggcaaaaatatagagaaccactctatttttgttatttgtgtatatattctgtggtgaaatgatatttacaatttacccagagtaattaccacttgtgtccatgcctggaaatttatcataaatcagtaattcaaaaaaggaaaaatctatttactcaaaattcctattgaaatagtttacctggaaagaaaaaaaatggataataatctaatgaccagtaatagaattattaaaaattatagcatatcagtgggaagaaataatgtaaaagcagtacattaattataatgtgtttatagaaacacggaagattacaaacagaactttcaaagtgactgaactaagtaaaaatgcatatgcatgctaacatagattgaatgccaataattttaataatatatatttttaaattgtgatgacatagcaacttttcttctgctataaaaatcattaaattattctgggtttaaataaaatgaacatatattaaaacatgaaatgatggcagtgaagtgtattccttagaagtaagtacatgttgcaaagagagagtgagatttattctgattttcacttttgtatcatcctttcacttatcagtatacaaaagaggtttaaagtgttttcgctatagattaaccttgcctgctgtttgaatagtgtgtttttaagtacatattttaatatttagttcaacaggttccaacaatcataaaacagtcaaaagtccaagttgcctttcccttcgatgagtattttcaaattgaatgtgaagctaaaggaaatccagaaccaacgtgagtattgtttcaaacgaagtggttctttaaatgcgtgctgttctttatgctgctctttactcttaccatcacaagcctgttggactatgaatccacgcatgattaaagctaagggtttacaaaaaatcatatccatgcaaacaaaaaaaaaatttggttatttcacatatgtttttctgccacttgaatttattttgaccataaactaagggctgttattaaaatacttagagtagtctttggtacagcagaaatactccacaatcccttagtctacaaataaataaggtagctgaaaactagaagatcctttattctacttagtaaaatgtagcatttattaagtcaaagtttgtaaataccattctatacatatttataattgtgcgtctttaaatttaaacatcttattttgtggataggttgttacttgattttttttaagttgtcatagaaatattgtcatctcaggtggcagagtactattgcatgatatactactatctagtattattttattttagaattaaataattgttattctaggtgaccataatcactgatgagctttttcaaaataccttctatgtttggggaggaagaaaaaaatgtggatgtattggaagtgagaagggagaggctgtgggaagaattcccaatattaaaactctacgtgattctaaaatggaaagcaaagctacatacttttattattctgcatgattatcttatattcattaagaatatccatatttaatgaaaattgatgattttcaattgtatcatgactattattattgcctgatgggttgatatttaataatcattagtgacccattaacatgctaaattataattatttctatgtttaaccaaatggaatatattcaatcaaaatatgtaagtatggatagaattacaatggaattaaggataatttattcaatcaatatggatatattgatcaatatcatgatatattaatattaattagctgaattattatgtcaaaaggtaataccatacacttgtcaacagtgaaatataagacacacagagagaagtaaaataagtcaggagggtggctgggtaggcctactcctaatgagaatacatgtccattgaaggtttgttattcctgttggaagaataatcacatagattagtgtaagaatatggcgtcctgaaatatacccaaatttgcatgggtaattccaatatacaatgctgaatacaatctaattgggaagtcattgtttgtctatcagactgataaagatttaaagagacttcttaatgtcattgttcatagaactgacactctagcatactggggtgggaatttaactgtgtacattttttttctagaatataattttgcaacatttatcaaatactataaaaagtttttaattattggtttattaatcttatttctaaggaactggcatattgaaatatttggacaagtaccaaagaataaatatatagggttgtttctcacaatattgttcataaaaggaaaaacattgaaatggttaaaagtaattaaattagtaaccatatgacagaagataatgtagctataaaaattgtctttagtatcattataataatggaaaaattcagttggccaaattatatattcagtgtggtctcaaatatgtgacaaaattctaaaaatactaataggaaatattagcaagtgtaataatactgggcttatctgttttgggattttgagtgagttccttacacacacaaatacatgaacagaaattatatatgtttcttgtagtctccagaatattaataataatcttgtattacctttctaattaaaaataaataaataattttaatttaaaaaagcaaaagctaatttcaatcttaatcctctcatttatcaagctgttttatggacagtaatatttctcagattcttctgagacccttatttatatcctgttatattccattaagtatatactttttatcataaaatgtcttggttttgtcaattttatgcaattgttaataagtactctaaacatatgtcattatttttcaggattattaagttcagttttatgttttagattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatcaacttatatgtgtcttgtattttatttataaggaaaaatttcctccaggtcttgatacttaaaatcggatgaccttagaaaacaacataatttgactctgtttcagtaaccttatatctaacatggaaaaatataatatctgctttgccttataagatgagaattaaacatattattagttaaacttggctaaattctatgcagtaatagataaccccaaaacctctatgtaaacataaagttattccccgataaagcaatttactgtgggcctggcaactctttcatgcagccttcttgctgatcacagctaatggagacatcgtcattctgtggttgcctcttgtgaaacatgccattttggtcaaagagtctgggacgaaacatgaaaaattgtacactggctcttaaatgcttctgacaagaagttatgcaggcaactcctactcatgttttgttaggtggggcaaagcaagttgcatagtcccatctaacatcaatagtatgatgctcattaggaaaggagaaacagctattggtaatgttaaccgtaaataaaatttgtgtaaaactgcaagacactttgttgttagaggtgtatttatcagtaatcgtcccctgaagtagcgtactttattcatagcttatttgccctatgtgcatgggatatccatgaccaccttttatattttatcacgttttccccctgttcttaatatatccaccattacacaattttagccaaagcctttatagagtaaattggtaagtataaaactgtcagccagcttctattcggtaatttcttcttttagagtcctagatatgaaagtatttcaaagaaagtcctaggacttgcaaaatatgaacacttgattctgggggtgcagaatggccacaaacttcagaaaaacaaatgatgaatctttaacccaaaagttcagagagggcattgtatttaaattgtcctaaagtccttatataattctagaggaaggaatataggtcaaatttagactcggaagtaaggtgtgcatcttaaaatttataagtatgtacactaaaattataagaaaatagtattatcacacaatgtggttgatgcagggaagaaaaaataaaggagagaaaaaaagtaagacaagcagaaagaaaaagagatagaaataaattcaaatatatcacaaatgaaagacaaaagtaaatagaataaatgctctgagttaaaaaaaagctataaactttttacaacacatctatctaaaccttaaggatacagaattgttgaaatgaaaaagacagaaaagatatcccagacaaatgctttccaaatgaaggtaggtatgaccatattaatgtcagtcataacagactttatttgtaaaagccttcatggaaattaatttactagacatatataatgttaaaatacctgaagcaaaaatagaactacaaagagaaatagacaaattcaccataataatgagatattaacatatctttttcattatttgctcactcaagcagagaaaaacatcagtgagcatatagaagatttaaagaatacaatcacaagctccatctaatgaaaacacatagaatattgtaactaacacggcaaaatgagttttttcatacacatggggtaaaaggttatatttgatgatatattgggctatgaggaaaatatcaaaatgtaattaagttagaaatcaataataaatagaaaacttaaaaaacttatatctttgaaaactaagaaatacatttctaagtgagtcttaggtcaagtaccaaatggtaaggaaaatagaatatattttgaagtgatgacagtgaaaactctacataacaaaacatgttgaatgcagtgaaagcattatttagagggatctttatcattttaaagacatattagaaaaacataaaggatgaaaattaatgatcttagcttattaggtaacataattttaggataaaaatgaatgagctaatttaaggcaacagaataaactggagtgaagggagaaaatagtataaaagcagaaaataaattcaacaatgtggtatgtaatctttgtagtgaaagtatccatatttattaaaaaaagaaaaaatctagacaaatagaaaataagtaaactatttctatttattggaagaatctatacacttaaaatgctcattctcaatgggttgatatatagaagaattgaaatcagaacgcctatagtttagtttttgtttctgtttgtgaaatgtgaccagctggttcaaaaatatctttgaggaacaaagggcaaacttcagtagaaattattaaagaataacaagtcataggggattcttgttttcagaaatcaagattcagcttaattcaggaattaagccattatggttctgtgcagggttacacaaatcagaatagcatagtaaacccagaaacagaccatcacatgtgtaaaaatagttgagggaattggcatgttagcatggatctctctctctctctctcccccactctctttactttgaactaaacattgtggaacaattgataattcacacagagaaacatttatatggacttccacctcatatcatataaaaatcatctcagagtggataaaaggctgaacagtgaaaggaaaaaatgttttaaaaagtgagactatttgaacaatacgtttatcaccagggtcattaatacagagaaagatttcttttcctttcttttcttcctttctggcttttttgtttgtttgtttgtttgtttgtttgtttttgacaggaactcactctctccaggtcaggctggagtgcagtggtgcagtcatggcttcatggctcactgcagtcttgaactcctgggttcaagtgatcctcccatctcagccttctgagtaactaggactacaggcgagtgctaccgtgcctggccaatttttatttttatttttatttttgtagagatggggtctcactatgttgccccgggtggtcttgacctcccagcctcgagcaatcttcctgcctcagtgtcccaaagtgctgggattacaggcatgagccaccatgcccagtgtgggatgatttctttagtcatattaaagcctcatgaaggaaatcatcaagaatacattctcctacatttgattttagatcctttttttattgaaagactctaggaagaaagtacaaacaaaaataagccacaactcagataaaaattattgataatgcatataactaaaaatggtatgtattcataaataattttacaaatctttataaaaaaggaaaaatgacaaagtggcaacatatataaacttgaacctcagactggagggccaataaaaatgtgaaaatgtgttcaacctctttagttaccagaaacagacctattgtaaccctagtgataaaagcatttgatcctacccaattgggaaatatcagaaaatccaaaagtaaaaattttagattgcaatatacatccaacagaatacgtatccactactgatgacagtccagtttactgcgtgatctttggaaaacattttctaatcccctccttcgttgaagatgctcttacttatgaccaaacaattccgttccctagctcatgtgcatgtgcctcttgtccatacataccaggaagatttgtggtcacattgtttatatttaaaaatatgctggaaaaaatacagcagtccactcaaagtagaatggatcaatgcattgtgctctattcataccaaaaatactattcaatagtaaataaaacgtcaagaatatgttgagcaataaaagtaaatcttggagaaagtttgaaatatgtaaaactgactacaattttgattggtataattttattgttaaattataatgaaaaataagagaatgataaaaacaatattcatggcagtaattacctgtaatggaagtaaaaattggaaaatggaagtgggggttgagatcagcacctgacaaaaaggtgatgacgatattcctattttgtaaaatgggtagtaagtgaatggatttccattgtgtttctttctttctttgtgttttttttacatttattctataaacaattgttttatattcttaaaatgagtaagtgtgaagcatcccgtttgtctcaagtggacatttctgagttactgagatattttagaatcagaccagtgacatgtcaacctgaaaattgttctcaggagtttggatttgaattgactttcagtaggaaatgtccatgaattctggattagaaagtattgctatgaaaattgtggttgatcatcgttaaactgtatattacatttatatacttcactgaaataagttaagaccagagaaaaggacagataaaatatcttttgtaggaggcaagtcatgaggatgattcctaacctaaattctaggggttgctatggagacacaaaggaaaaggcagcagctagatctattgcaaagaaaggagcggcagaatttggtttaagattctgcaattaaaggatttcagtttttttttctgtcattatctaggcagaccaagtgaagacatgaacaatataaggataattctgaccagaatatgatatgagagtattgtattaagagctgggagttggatctgagctacgttgttggataattgctctattttttttattttttttttttgctgctgctgcagaaaagagcaaaataaattaggtttcttatgcatcatttccagcctctcctgaaattacttcatcatctgacagctttctgcaaccatctatatattgaatagtaacccaacccaatacttaggagtttataaatcagagacaatttaaagcttcctacaatctttaatcgattcttctcttaaactgtagagaattggttcttctcaaagattgatagaaactttgtgattcaaatgttacagtttctacttctcaatctcctgttaacaaacagaaacctttgtatacaatgtccagttttctattttcaacaacattgcagttaagtttcctagggaaagagtgaaagaaacaacaacaacaagaaccaaacaaacagaatgtaccatttttatatacacgaaaaactatttaactaaatgtattatccaagacatggcacagggattttgtcagtgagttattcaacaatcttcctgaaactcccataatacaccagccactttctagtaatttgggatttaacagtgaataaaaacaaagactgtcctccagaaatatacatcctgtgcatgtatatggtgattgggtctggaaaggaagggagctactctcttgccttcattatccaactatcagtaaggttaaaatgataatataaataatcctaatttgactgttgaatactactcacacttcagtgcacagattagatttctccacttagcattcctggcctattccagcctagataatttttttcctttttctgagtttttaaacaacttgtttgtttgtttgtttgtttttgttttgagacaggatcttgctctgttgcccaggctagagtgcagtggtacaaacatggctcactgcagcctcatcctcctgggctctagcaatccttccacctaaacctacccagtagctgggactacaggcatgtaccaccatgcccacctataaacatcttttttgaagtataatttacatatcataaattttacttgttttaagtgtataattactagtttttatacattatttatttatttatcttagagatggggttttgctatgttgcccacactggtcttaaactcctgggctcaggtgatcctcctgcttcagcttcctgaatagctgggattattggcacatgacactatgccccaccaatgacttttttagtaatttttttagtgaagtatcattataatgtagtattaaaacatttccatcaccacaaaaagatttcttgtgcccatttgcagtcactctctgttcccatctccaggccttaggcaaccaccaattaattttctgcctccttaaatgtacttttctggacatttcatataattggaatcatgtatatggtctttttcatatgtcttctttcacttagcatgttttggaggttcatccatgtagtagcatatatcagtagtttatttctctatattgctgaagagtatttcactgcatggatatcatttcctgttaatccatccaccagttgatgaacatttgaattatttccacttttggctattataaatagtgatactgcaaattctctggggttattaaagcatttagttgtgtactgttagggacagtctatcaattgtcatatgtattaattaggatccttaagaatgagaaaaaatatcagacagactgtcatatccttcccgttctgcattgccttgtagatgtcacaagaatgtgtattatatttatttcattgatttattggttgataggctgaaaaataaaagaatgaataaaagtaacactgcaatttgcacatgctattaaaatagtctacgaaatgtctgacaaagatgaaattttctatataataatttaatgaaaactaattagaaatattcatgcactaggtttctacatttgtgttaacatacttcctcagattcctcaggacaatttccttaagataaaccctggctttttaccaccctgattttggagggggagtgtaggaaacctggatgttgtagcctgtgctaaattctcctaagtgcaaatcaacaaaaacagatcaatttgttcaattaagggtgcaactttgaattctaaagctttaattaagttcgaggattttactctgattcaccaaagtatgtgaatgcctgtaatgaaatgggctgaactgggtgtccttccttagcatgaattcattatgagctcatggactgaaagccagtgttatttctctgtagtcctaagtggattaatgggatgttctgcaggaaatgggaatcaattaaatctctttaccaaaggaaaccggagttagaggtgataaagtatgtgcactcagtagcatgcagttgtgacaatgatggcagactgtgagcaattcgccaagcatatttaagtgaaatgtacggccctggaaagctcaccaggccagtcctgtaaacggagtgccaagtcaaaatagataaagctttttggtataggaagattcgtccaatgatggaaaaagggaaaataattcaataaacacatcatatgttctacatgaaatgaacaaatgaacaggattttcttccttctgtccttctacctcctctgaaaatgttaattcaaataattgcacaaagtcacagaagttgttgagatgcaggctatggagaaaatcaggagcagcagcagaagaaaactccctgtccctttggcctaccttgtctctgtgcgtttggctgtaccatgcaaagtgaaaatatttgaggagtagccaagatgtattgaataatttttaagtgcttgctcctattttaatcgattcatgtgaaatatttaaatttcaacataaatcaaatgagttaggtgttattacatttcccacttatgaatgacgacactgaaacatattaagtagcagattcaaagatcgcataggaagagaagccaggacgcaggcccaagcagctgacttcagtgtttatggataatctgatgctacagtgttgtctgtactttgagactcaggtaacacatgctacagatgagcaaaaaggcattgtacttctttgttgaaaataccttgatactagattacagtatcatctagaaataggaaaatataaggaaaccttctattttgttcctagagtgccggagaatctgtagtgttgcataacatggtagcggttaagatgccagtgttttttggtttttgtttttttcatcacagtggttagttagcatgaattgtatttagttaaatttccctgatggcatttcactactactcttcactattaaacatgttggcatgatgggattacacagcttaggttttattatatctctacccttaagaagcttctaccctggtgaggtgtttgaggagcctagagagatgaattcaaaggattctaagacaccaaaggaaaacaaaatgagatacagaaaaaggtaaagatattggtctgaatctttgtaaccagttagttttctagtgcctgggctagaacctagtttatgctgtaggatatcctatagatataaattctgttttcagaagtcttctttatttcaggaatgaagatgctatttttctgtatattatgttgaaataattgggatgatgagttttcaaaactcattgacagcatctgaagtcatagagctcctgcaaattttgtatctgcaggttggttgtgccttgatagttgtggtaataagactcctgtgcagctagcttgtctgtagggaagtgtttccatgatggatttcaact

SEQ ID NO: 679 - DNA, 330767 bp, Homo sapiens
aaacaaaaactcagtggtttggagaaaaagaaattacctaattacctccctcttcaatccagtccttgagtcctactccaatcagacaaacccacacacaaacacatagcctgtcatccatcacctccatctgcttctccttttctgtctgctcagccacatgcttctactgaagactgtgtctatgccaattttccaaagcttcttccgtctcgggccattgctgatacttgaccttttactttccaatctgttctgtccatcaccagtgtttaatatttctatcatgtgcatttaaatgattattagcgttctctttcaggaaagaaccccatcttctctcatttgtcttactcgaaggtgacgcacagaaaacttgataccaagttgttgcttcatgagcactcaggattggccagcttcatttcatgatctgtctaggttccttgctctaaatctttcaccggatcagaaacatgaaacaaagtggtgctttaagttgcacagtctcccccttattgcttgaatttaacgctgccgtcacacaacaatgaatctttcacctggaggtgtggtggtgagtgagttctcactcttagttcccgtaagagcctgttgttaaaaagatcccgtcacctctccatgatctctcttgcttcctctctcagcgtgtgatctctgcacatgccagcttcccttcaccttccactctgagtggaagaagcctgagcctttcacgcgatgcccagtcttccagccagcagaattgtgagccaaatagttttttctttataaatcattcagtctcaggtattcctttatagcaacacaaaataaatttagacaattcctctctgatttttaacttcttcatctataaaatggagataataacacattctttaaggtatctttttaaagcctaaatgaaataatacttaaaatgcttagcagaatgtctgacataaaacaggatattattgattattaattgttatagtaggcagtgaggtggcccccacaaaaagatatgtccatattctaatccccaggttttgtaaccattatcttacacggcaaaagaataactatttgtcttatagggcaaaagatgttattaatctaaggaccttgagaggtggagctatcctggattatcctagtgcaaggtaaatgtgatcacatccatccttatcacagagaggtggaagaaatttagacacagacacacaaagaagaagaagatagacagaagaagagtgggtgatgtgagacatagacagagattgaagtgatgggcccacaagctaaggaattgctacagccaccagaagctggaagaggcaaagaacaaattatctccatgaggtttcagagggagcacagcccttctgacactgatttcaactcagtgaaactgatttcagatttctgacctctagaatttggggaatataaatttatgttcttttaagccaccagacatgtggtactttgttacggtggtaatagaaaactgatacagattttattttgttttgctttgttttgagacagggtctcattctgccacccagactggagtgcaatggcaagatcatgtctcactgcagcctcgacggcctgggctcaagcaatccttctacctcagcctctcaagtagttgggatagtacctgacagtagccaccaggtctggctaattttttatttttttgtagagacagtgttttggcatgttacccaggctggtctcgaactcctggactcaagtgatcctcccacctcagcttcccaaagtgctgagactagaggcatgagccaccaggccaggttcaggttttttatatttgttgtaataaatttctaaaaatgtagaagtggctttgcaattgcatagtgatagaagctggaagaatatgaggaagcatgataacaaaggactacacttctttgaacagactatttgtagaaatatggacattgaaggagattctggtgagagctcagaacaaagtgaggaacaaggtagggaagtcttctatagttttagagaatacatgtgttgtcatagaaagaatattggtagaaatatgaatgttagaagcacggcagaagagggttcagcaccaggaataagcagcatgttattggaaactggaggaaaagggatccttattatatactggcagaaaagttggcttaattgtgtcctacaatttttgtgtcaaaagcaggatttataagcaatgaacttggatatttagctaaggagatgaccaggtctgctgtcaaaaagtgcaacctggtttcttcttgatgcttattgtagaatgcaagagggaataaatggattgaggaaggaactgttaagcagaaagaaatgatgatttaataattttggaaatttacaacctatcaggattaaaaagaaacctaactaatattgagactaaggatcaccgttagaaaaaagaaatgctcttgagagaaagccaaagttgtggctggacaggaatttaataattgcagatgtgtgacttctgaactcactcaaccgtctcaacagaagctaagaagagttgggtttatccaggaaaggcctacggagtatgctgttgtttaattatatgagtccctgtgacaaacatgggagacccacaaggttttggggaatattgtatcagcagaaacactgccagactggcctgaaagggacatacatgggacataatgaaggcagactgtcagacttctgggattttataggcagaaaatgggctgatagaactagttggctacaaacatgtattatcattcaaaaaaaagagaagaatgactctgagtgcagagccttgggtacagagggcaaagctccagacccagagatcatagcttcaagcaacagaaaataattgtcaggtcttgaaacctaaggaaattttccttgctggattttgaactggcttggcatcagtgaccactttgtatcttccattgtctcccttaaaatggcagtgtttataactattaactacacttgcccatcattgtattttggaggcagataactttttttttcgaggttctcatgtccacagatggagagggattttggtgtcctatctattggccctgtcaagttaatatataaaactaacaatcacacatgtatccttcaaagcgaaaggaaaagggagtcagagatagacacaaaacggaggacatacacagagaaggcaatatgaagagagcagcaaagattggaatgatgcaactacaagccaaggaatgctgagggttgatggtgcctaccagaagttaaaagataggcatgcagcagattctcccttacagttttggaggaagtgtgaccttgccaacactttgagtttggacttctggccttcataattatgagaaaatacatttctgttgttttacgcctccaggtttgtagtaatttgttacagcaacctagaaaacaaatacagttctcttagctcttggtaatccccagaaagtagaataggcattagcccagagtaagcataaaatgttactgataatgttatgtcctgatttatagttcatttctgaggatattgtgtgtgctcagtaaatgttttttgacttgaataaaagtcccaaaatgtgcaaataggtgtcacggacatctctaaaatagcctcaaagaacatttctaaaatgtccccctcctcctccctgtcttctaaacactcatttcaagtaaacactgcttcgaaagcaagtttaaaatgcagcttgattgatggctcatcagcagcaaacaatcacattcaaagccgcatatttacatggtcaatacacaaattaaacatgagatttccctgaagtcactctataaacttgttagatcaaaagtcacttatgcacttcatttcggggaaggaggtcacccagcctgcagaacacagattattcatggcatgaagaaattctttgtttcgcagggttaggcttggatcagaattgcggtaaacctcttggctagtagcagaatattgactaaagctctgtcttccaccagtgcagaggagaaagccctgtcaaaacccacaagaaatctttttcttgtttctaatcatctcaaacactgctgaatactttatctctcacaggagcagacttctttgttctcacagttacgaaatgaaggggagggtgagggcaatctgttctcagccagaagcaaatgaggttttgcaagataaccaggggcatagagacttctcccatacctggtaaaacattgtgtctagggatgccccaccccaggcatgttgccttcctctggacctgtgccaagatcccgaacaaacctaaatgggaaactcaaaaccaagcagagaaaataactgaaatccaggaggagttggtttatgaagcccaattagatagcctgaatattgcattcaaaaggtgactaagtcaagacttgaaaaacatcagcataagtcagaaggatgtgagtggtaaaactggcaaggagtagacaaaatgcaatgggaatagtcaatgcatagagaacatattttttaaaaagagattaaatggcagtgtaaagaaaatcttactcttggtaaaacctcagtatctctcttttttaggattgtatttttgggttgctagcttcaggttaaaatatatagaaaatactgtagtattatgaaggccatactaccaaatttttaggaaatattctatgctaggtattacattaaatattttgttaatctctaacatccctacaagatgaagtcagataaagatagaaattaagactgaaagattaaaggacttgtttcacatcatacagttcataattgctggagcaaagataagaattcaggtctacatctttccattagatcatgctactctttagtcaaactctctaaactactcttcaccaacaattaacgttttctctgtaatatcatcagtaggcgaatgagacttgttaccagcactctattcaaatgtatgtggggtgaaataataaagcacttgaattaagggagattttattcaatgttttaggagagattctctcagcatctagtatccctagttacccccttcagcttcctgaggaggattatttctccttgtctctacaggcctaaagaaaggtaaatcagatgtattaaaagtgccttttcaacttatgagaatctgcagtatgcttagttctttgctgggacactgttacaaaaggaataaatgaattactgaagtctctgctctcaggaatttatcatgaagagggacagagtggaacttcacaaaattattaggaagtgcaacacaaaagtcagtttaggtcagagccttccctcattctgattccacattctattgctttgaacatgttcatttgtccgatctggagactaactgtttcttatactctgatggtccccttgggtttacaccggtttccactttttctgctctagtagtaacgtctccttgttaggcattagggcttttgcagaatcctttacaatatgacagaataacatgagtcaattatttatagttaaggtgcattgaaaacatatatttcaaaatgaacatggtgcagaacttgctggatatagggaatgaagagaactaagaggtttgcaaagaagttttgggtgaggaattgagaaagaaatgagagctgtgagaggatgataggttagaagaaaaagggaaaagaagattttacaaagtgttaatttaaattttaaatgaacagttttccttttctgagaaatgcaagttaatggatgtgctgcagtttgcactacttctggctcctgggctgagtgaatgtcactaggattctcctcagaaactctactacatgggtgccagcttacattcaggttacatgtatgtagcactgtctatgtggaagcaccattctaggcactaagtatacaatagtgatcaaggttggtgatatggtttagctgcttccccacccaaatctcacattgaattgtagctcccataatgcccacatgtcatgagagggacctggtggtagcaattgaatcatggggcaggtttttcccatgctgttctcatgatactgtataagtcttatgagatctgatggttttgtaaagggcagttgccctgcacacactgtcttgcctgccaccacgtaagatgtacctctgctcttccttcaccttccaccatgatggtgaggcctccccagccatgtggaactctgagtccattaaacctcttttctttataaattaccaagttttgggtatttattcatagtagtataaaaatagactaacacagctggcatagtctccagccccaaaagaattcaaattccagtgaaaaggcaatgacagaaattatcaccatagtaggactataatttgtgaggacgtatgatgctttctaaatatggcaccgtttattcctcagaccaatcttgtgagattagtgttatcaattctgtctgatagtgaaagaattcaactcagagagtccaggttctgttcagtggagatgcatataatgaacagctgagctgggattcaaaacatagatctgtctgagtccaaaagccttcatcttggcagtggaatatagtcaatggctaagagacaagaaacaatggagagcttagaactaaccctttggagatgctaacattcctgggtttggagaggaaatgctggtcaggggctaaataaggcactcaggatgtcagaaagatgtgggacaaaataatgcaaggtggtataatatttctgaaagctgaagaattgacattatctaataatagggaaaaactcaggatgtagtcaagaatcctttatttttggaaatcctaatattgaaagcatagatttcaggtggatgttgaagtctccaatggccaccaaaactgcagggctctaaaaaggtgttaggttttgagaaaaacttaaatgtgacgcagaccttttattcagcaaaaaaaaaaaaaagttgttgcaaaggtaatcactaaaatggacaggcattttaaaatattaaaacaatgaggtttgttgacaggtatctaatagaggaaagaaaaagccagttgagatggcaatattgaaaacggccacctggcacacaacttcggggggtgccattcatcttgagctctgtttcaaggcatgtgttactcatagatcacaatacgaatggtgccctctagagctgtgcaacgcgcatctgtgcaacgatgttgctgtgagagggagtaatgtctcataaaaatcaacatgaaagaataggaaaaacatagtcttggtatttagaaatgttactgtgtgcccttgcgtacttcattttattacctggacctcaatatatataaaattgaaagaccggactgggtgaattgtattaagagcactaggaacataaattcaaatttgtgctgtatttacaaacctcttttcacaatcacaattacatttaatataataaaatgaatgatggcatgttattatattcatcttattattctcatttttattctttttaattttttttttttttgaaaaatagagacagggttttgctatgttgcccaggctggtttcaaactcctggctttaagcagtcctctcacctgggcctcccacagtgttaggattacaggtgtaaagccacaatacccagcccatcttgttattttcataataaataagcttttagtttttaacctgaagttcagtaagttcagccaacttgtctgtgatcagacaactagggactactggtggccaaaataaaaattcctaatggcaaaccctatgtagaaggggatgatgtctaggaaagagatggaggattggtgatgcattcacattcttcttatgatctatttgcagatgtcttctacgaacatttgtttcccaaaccagagaaacccttattcactcattaaccattgggatttttgttcaaaggcccatgaattattgctactttaaatttgcaagcaaatttataattggatcctgatgtcccagcacccataaatattttataataattgtacaaacaacacttacattaaggttagtgtaaaagccttagtaaaactgtcaaagcaatttaaacagaaaaatatgattaaggtgtactttttacttttttcccaataaatataacttgttttatgatattccaggacatgaacgattaaaatagggagacccccatctctaccaaaaaataggaagaagaagaagaagaagaagaagaagaagaagaagaagaagaagaagaagaagaggaagaacaaggaagaggaggaggaggaagggaggaagaaaagaaaaaatattagcccgtggtggtggcacacacctatagtcccagctatttgggacgctgaggccagaagaccccttgaggccaggagtttgaggctgcagtgagccatgattatgctactgtgctccagcctgtgagacagagtgatatcttatgtcaaaataaataaataagtattggtgaaaatataataggataaaattgcaagccataggaaatggaagtctagcacttacagaggtaagcaatcttatttagttgaaaaagcagcagtacttagcgccaccatacctaactatgaattgctgccaggtccctttaacgtctgtgggttttggaaccagtgatttaacctctgtgtggctccatgtcctcagacctgaattggaggtcatacctatctcactaaactgtgtgacaatttagtacagtaagtatgtgaagtgcctgatagagcatgacaaatggtggtatctgaattgagagtagtcatgttcattaatactaaaagttttacaggacatttttaaactgtgtattcatctattatgtttcaagtgatgtttaatttaagacttttcagtttgacgttattgcaacagagacatgtttcccatatgaccacatatattcctccctaagtgttatatgttgcagactattcttgtaaaaatatgagacagttaatttaaattcatatcattgattatgtatatggagacaaggtttattaaaattggctggttgacttgattatatcaatttgtatttagggatctatggtcgataaattagatctgcgatttcttcctttcctgagtttcacaggctttgatcaataatttagaagcagctttcttttaaaagacatacgctcaacataagcttaactgaacgacatggatgttaataaaacttttctggctttccaagccgtgattttatttaaaactgaatggacataaatcccctctcatttgccaaatataatttaatcatgcgatatgttatggttattaaacgttatatattagagtggggatgatctgggcgtgaatcctagccttactatttactggtgtgtgtcctgacacaagtttgtcagcttctccaagcttctgtctgttcattggtttaatgggcataataatacttaactcagaactttgtctgaataattaaataaagtatatatatatgtaaagttatatatatatgtatttgagacagggtctcactctgtcacccatggagtgcagtggtgcaatcacagctcactgcagcctccacctccccaggctcaagtgattctcccacctcagcctcctgagtagctgggactagaggtgtgtgccaccatgcccaactaattttttttttttttttgtagagatggggttttgccatgttggccaggctggtctcgaacttctgggctcatggaatctgcccacctaggcctcccagaatgctgggattacaggcatgagtcactgtgctcggccaaactatcattctattttttttaaaaaatcatattatctatcatgtagtaaagcctcaataattgttactttcattatggatattattatttgtattgtttcatgagtttgaaatatttaccaaatgtctttagaaaacttctgaaaataaaagccttccaggaaattatttttattttctagttaataaaattttatgtttgaggattttttaaggtaaataaaataaaaacagttattagtttcttttttttttttttggcttagaactcttcaaaaaacaacaacagaaatgggaccatagattcattaaaaaaaaaattgtaacattctttcaaatgttttattgaagtaaaataattacagaaaattgttataaagacattggtaaagccacaaggcagataaaaaggagtttgaatactttgcaaactcctgatcccccaatttatagaagagaaaagataaggttactaagagcagaatacagaggcatataatgttgttgatgttgacatgaatcatgttggcagcttttggagttcaaaatgcttcttgttttcttggcagagatggtaatattgtgaagcaacagtgtattgaaattatgaaataagagtttttcatgcaaatgtgaggaatttgctgaggacaagtaagaagaaggccaattcctattgtgcaaatcctctggtcactggcttcaactaataaggacaagcaaaagcataggaagtcatttccctcctacaaagatcattgcaatgaatgggaactggtgctttctgtggctcacgcccagtgggtctgaggggaaatagaatcaataaaactttaaacatagtaagtgctaaatgaacacttcatgaattgaaagctgactagaaagccagctatgaagacatattctagaaccactggctggggaggaaaaaaagcacaccgaataaagcacaagctgcaataatctctttagttaatatccgacttatttttttttaagtataatgcagtacatttccacagtgcagaattagaaaatgcagaaacgaaaaaaaaatgatttaaatgatagtagtctatgatttatcacctgacgcagccacagtctagctttgtgattgcaagtgacttaattaagtcttattaagtctcacttcactcaaagcatgcaatcataatcccttcttaacgttttgatggggatgaatgagataataggtagcttagcacaaaatctggcacataataattgagtagcaaaatgggtagatttaatgttaaaatactatattttacaaatgtatgtctagtctttgtttcattgtatggataacagatttcagagttcatttcccggatatatacttttataacctgctccctctatttttatcataagtactctcaaacatcaacacaatctctttataaatatcacattgaatggctacataataggctatcataagacttcaccaactttcttcaattataatatcttttattgatagaaatttaggttgtttcctaacctctcataaataaagctacatgaaaatatgtccatcaaatttacattaatgattcctctggtaccttgaacccctactccttccacacacacttctctattttcacctctatccattccactgaggagtatggtagattcagtttttagtcctgtctctgaatgtcattcaactttactgggcctcaatttttctcctgcaaaaagatctccgggtcactctcaagcctaacattctactattttatgtcttgaacttttgcttttataaaggaacaggtatcataaaaagacgattaaaattcaagtcaccaaaccctgtcagtactgcctctaatttatgcgactggatgccaatacctttaccggataccaatacctttaccaatacctcgccttctgagtgtcattcacctgtttactcccatcaaggggcactgttgactcattgggaccctccgtctgtcattttgaaaccccaaggttgccagccatggaggcacccttcccattgaggcacagcttacagtgccaggagctgcctggcccccactttcatctctaacctcctctgaggctgcctttctctgactccccgtgcgctagctacagtgcctttctttaaggctacagtggcctttctttcatcttttgctatgccgactcctttcttgtctcagggctttttcacatctctttgctctgtctgacctgccattctctcgcatctcgttgcaggattacctttttattctttctttggtggcaatgaaaatatcgcctcctcaaagccctcccctgcccacagcataaaaagcagccctccccttccctattctgtaacatagtcccttattgctcagtgactatctagcaatgatcgcagtctgaatttgttaacttatttattcatgaatattttttcttcttttttgtttttatttttgtctctgctctataatgaaagctccatgaaagcagggactatagttgtcctgttcttcattatagcactagtctctactatgctatgtgcctggaattttttttttgtactcaatatttttttttaatacatgaaaaagtattagttggccagatttctgcagaaattctgtaaacaaagaaatcaacgtgaacgcaaacaaaccaaaaaccctaactcagccttgtttaaacctgaataaaataagcaatatcaggagtcttttaatatttgtgaaatgttagctttctccttacattaaacctaaacctcaccatcttgcaaatggccagaacgcctagtaaatcagccttcaccttgacagaggaagaatatagagaaaggatttcaacagaactgaagtgagggtgatcatagcaatcttcagtgtactgagctgatttataggtacagactacttctagattaccgacctgccactgaattccaactaggccccttaaagtattcctgcctgagaaaaacaccccagctctggatgcaccatcaatattaaattccacgagaaaggtggctgtgaaaaacacacacgtcttccacattaatgattcaggtgactatatcaagagcattgccttttacaccgcagccctgcttttcttgaataaagctcatatgttttttgtttaccataggactctcattctttcttttttcaaaaaaaagtagacttagcttgtcttttccaaagtattactttccgcagtttgccaagtcacattggttttggtttatctcattccgtttttattaggttggtgcaaaagtaattgtggtttctgccattactttcaataataacttaaaaaggacaaaaatcaatgttgaacattggccactgtcaaaccaccatacatggtctacctcattaaaatcagaccacagagtctgtaatgaattcttgtttcaggagtttactatcaggcaaggaagattttctgtgttaaggtcaaaaaatttcattcatgctgcaaatcactttgcttccagtcactgtgcaaaagttcatgtctgtttatcaaggatttctggatgcctcctgctatctgtacatgtgccagaatctttgaagagagcattgtttttgtgcagtgaattccagttcaggacagagaacattcctcctcaaaacaaccattttagaagacagccttcagtgtagtatttcttacactgagtactggttgagctttgctgtgtatttctctctctctctcctctctctctgtatgtgtgtgtgtttcttcatcctgaagcgttaccacttagccccagggggaatctgtattattacttgtagatgaaaatgtggtaaagggctattgtgatttcaaaacttccatattttctcagataaagtttccctccagttccccctccccattgttttcactctgagagcctcaagttgggtgccaattaaaactgagagaatattacagtgtcacagaacaactatattaaccacatttgtcaatatgtgccattttcattttaaatgggaaagctcagagggcattttccactggaccatctggaggaagctgatctggcttcctcagccagaggttttaccagttgccaccaataaggaactattttgtgatgtttccagaatttgaaaccctctgccactttgaatccagcttttaaacgtccttttgcaaggcctgccaagagcgaacttgtagagagccaggtttcatttgcaattcaaagagacaaccctatcattgaatgtggtctttaaagggaagggagagagcaaaagtttgaaaagaaggaactcaaggaagagatccttccattttgactagatattgtgaatgtcattcctcttgaattcttattgttcttaaatgctctgctcagtgcctgtcctaggtcccctagcttatgattgtgagtcaaagttgtcagtcaggtcatttaaactcagaagttaccagtgtctttttcaaatttgtgagaatagtgctagctgccccaccaagctagcataaggactaactttttattgatcactggaagcaattctggtttctcaaagaaatcagactagttttgacataaaacagaatttggcaacaaagctttgggcagaagcacgaatacttaacataggagaaagcacagtgcatgcaagtaggtgaaaaagaaggaacttgaaggtaggaaagagggcgtgagatgtccatgtatagggaatggggaatggtgtggggaggggaaatgcaagaagccagattaaggaaattgaagtgtagagtgaatagatcaagctctatctgagaagaagtcacatatgatctttctgtaaatgagtagccaggaagggtgaaaccattccaacaactgttaaggttttacatattttgtttgtttgttttttgagacggggtcttgctatgttgcccaggctggtctccaactccaggactcaagggatcctcctgcctcagcctcccaaagtgctgggattacaggcacatgctactgtacctggcaggttttatatttttaaggatttaatcatgataaacatatattagtggaaaggggaacaacacaacatgtagaaaaggtaatattgggggaggcacatttacaaaaatagtttaattgccaccaaccagataagcaggtgtgacgtggccctacctctaattaccctgatgttagaacctgattattaactgaagtggtgcatttatataatgtgcatataaaaagcagtggactaaggaggagggcatacatctgaggatagtgtctgcccttgttaaagtaaaggggtcctgatccagaccccaagaggatgttcttggatcttgcacaagaaagaattcagggcaagaccataaataatgtgaaagcaagttttttaagaaagtaaaataatgaaagaatgactactccatagggcagagcagcagcatgggctgctcagctgctgatacttagttacttgttgattatatgctaaacaaggggtaggttattcatgagttttcagggaaaggggtggtcaattcccagaactgagggtttctctccctgttagaccatataaggtaacttcctgacattgccgtggcatctgtaactgtcatggtgctggtaggagtgtctcttagcatgctaattcattataattagcgtataatgagcagtgggaatgaccagaggtcactttcatcaccgtcttggttttggtgagttttggctgggcttcttcactgcaacatctggaggaagctgatctggcttcctcagccagaggtttaccagttgccaccaataaggaatcattttgtgatgtttccagattttgtgatgtttcctttactgttttatcctcaaggtctttatgacctatatcttgtgccaacagcctatctcattctgtcactaagaatgcctaacctcctgggaatgcagcccagtgggctcagcctcattttacccagcccctattcaagatagagtcactctggttcgaacaactctgacaccctggcattaaccagtttcaagacttgggcacagacacctcacctctgaacattaggatctttgtctcctgagaaatgtggtatggtggaaagaaagcatttgagtttccacgccaataactggattaatgttatgcctcatacactcaacagctgtgtgacatcagacgatatttccactctctgagtccatttcctcctctttggaataagataataaagtctgttttacaggaaggagtgtgattttaaaaaaagaatatactgaggctggcacaggtaggtgataaataaattaggtgctaaagataatagacggttattaactttctaatgaagggctgaatgacatttgtgcttcctcataacccctagaattttctcattctctggattattgttaaagatagtgcatattcaccataattatacagcacatacttatttcttcacattttcaacgaatgtttttctttggctgtctttaccagtttatttcagaaagagagaaacagcagaatcactgggccacattaaaacaatatgtcaggagaaaaattaattccctaatggggactttctagaatatttcctctgcgtgttcccaccttcacaaatgatgcaagataaagcaccttccgtctatctcaggatgtgattttacaatcccaattatttttactgtcaagaagcattttctccatttctagtcaaaatttgcctccttaatttcaaattgtgccatgctaaataattcactgttctctttgttttgctggagattatgtatatactaaatatgttttcctcccctccacacctctcccccgatcctctctctctctttgtgtggctatttgaaggcacacaaatgtgccttccttaaatcaatagcttctttacaaaaaatatacacatgcttttgcactcagcatttgctatgctcctttgcaactgaaaatgtatggattaattggaatgcaattaacactcctgaaaccaagatcctaggattttaagctttgagaaacagaaaacataatgataaaagtaagagatatgaggtgtaaactaaaaatgaaatcctaagcctcccagctgactaagcagaccccttcttggctgaggagaccccagagaaaactgaaaaactaagtccctggccatgaagatacaagaagtcagactcacctcattataccttctcccttttgggatttagacacaacaactgacctgtattaatgtaaaaatagatatcatgagaatgacaaaatagactctttgtgacaataagatatcaaatgataaacaggacctaaggctgtgcaagacaagggttaagtcatgcctgcaggccatcaatttttcttaccaggtcatttgatcttgtatattgtggcttgctctatgactattttacttccttaacttaaacattcctttctgccaactccaagtttttagacaaagttttgctcctttaatcaactgcaaattaaagaatctctgaatccacctatgacttgtaagtcccccactttaagatatcccacctattcaggccgaactaacgtatagccattatgtattgatttatgtttttgcctgtaactcttgcctcccttaaacttataagaccaaactggactctgcctacctcaaggtttcttggctttgtattttccctgagctgtgatcactcatattgatcactcatatagaactttgcttcttaattcagccaaaactgggttcttgtcacatgaccaggaaaagttaggcatacagacacattgaaaggtgaggggaatggaatttactgggtaaaaaggaaaaaaaagaaaaaaaaatctctctcagcagagcaagaggggttcctgctaacaggcccccatttcacagattgattccaggccacatacaggaaactgaagaggccgggctcctccctgctgcaaacagcctgaacttctcctggctcaaccccgctaccctagtgcgcagactcgtaggagattccccagggtccctccttcttatcttcctcctgcatctatcaatattggttcagaataaacctttaaaaatattttactctgtggtttatgtttttttctgttaatagaggaaataaaaggatgagagtgatcttccaaggttcacccaagttatcagtagagccacattatgtgcctggtccttgatagctcaagggtcactaagacactaagacggtctgtatcaacatttataacgattttctaaggccctgcaagatctaggcaaaaatataatgaataaagagtaaaccatacttactttttcaggcttcccagtacgagaagaaggctcacaccgtttggaaataacttttttaagccggggtttaaattaaagcacgttttgttgttgttgttgtttgtttgttttggttttctggttgattttcagttactaaaaatttttttctgaaatactttttatcattgtggtttttccagatgtttcaattaggattcttgtgattccgatgacaactgaaagagaaataaaaaataagaaaaattatttcctgtaactggaagttgaggattaggacaagtaggcttcaagtttggtggagccaatgactcaacgacgccatcaaaaacttaggatttttcccatctctcaaaagatggagaaatgaatctgatctgttggttagatcctctggctgggggcctggtggttaaagcatttctagggatcctatgcttaaaaagcaatgtcaagaagagaaaaagaggctctctttttaaaaggctaattgattttcacagaaaccttaagcctcactgtccagtgttgagtcatgtgctcattccagaatggatagctggtgaggaacatagcattaccttaaacttacctcagacctgagcttctggctgtgtgggagaagggcagataactcaacaataccgtgggtgtctcaagaaaataacaactggggatggaatactggatggacatccaaccgtatcaaatacagcaggattctttgaattttattttgatatcctcacaaaaaaacataaaaataaatgatgttttgcatattctaaaccaatattggtgaagagcagagactctaactgattgggaggatttttgttaataaaatatccagtagttttcagctcacatttttgtcattatggagttttttgtttattgcttttatttcttcaaaatcagagtcccctgaacataaagctcataacaaaatcagagttccctgggagcatatagctcataacgttcttcagcatcttctaatgcaaacacagtctgagcttggcaactgtttatataaaaaggaatttgttcaggaaatattgtgaaaagtacagggaacagacacagaaatccacccaggctctgtactttagcattaggcttagaagagttgtggttttgcttcattccctgaaataaaatatttggttgattgtttggtagaggagtgtggacgcaggaaaccacagtgtatacctgggagaggaattggggtggataaactctcctccattgaggggaagcctctagctctatattttgcttctaattgacatagcagggcttttttcttcctgcatcaccactgtcctttctgcggttccagtatacatgttggatattggtttacatttctaaacttattgaacgcatgaccctttatcttacccattatttactgtttaactgtcaacttttactgcgtatactcaggcaataagacagaaaatacatcaaaacccttaatatcttcttgaaaagatctgaaattactcttgaaaatgaaaaattaggtctattctggatctctgaaatacaatattgtgctcttatatgtttccatcaaagaaggaaagagacatttatttagtataaatagtaatatgggctagactctgcactgagcattttaaaaatagtatcttatataactcattcaccagctctcagagttagtatcagatactgtttattgtccaccaaatagttatccttctcttttttatttttaacaaaatccatgtgcctgactaaaagcatttactctcttgcctctaggtgcccatggtggtagagttcttaccagcgagacacaattagaaatcttccagggtgtttgggaaaagctattattgccttcctgatacaacgcccacatcctctagctcccattgtgtgcatttaccctcccccatttatgatataattatcctagatagtttctctacatacatctagagccacatcagtgtcacaatttttctttcagccttcaaacatactttagaaaactcaaagagaagaagaaaaatctaatgtatttatttgtatttttgctgaccatgcttttctttcttttctatttttcgaatttccttttttaaaaaattttacttagagaacatcttttagtcactcttttaaagtaggtgtgatgatgacaaattctcttagtttttcatctaatgatgttttgatttcctcttcattcctgaaggatgttttcactggctgtgggtttctgggttgacaaatcttttctttttaagactagaaaactattttgtcatttttttctggcatccatggtttctgaggagaaatctgctgtccttcgaattgttcttttgcctatggataaaaattccattttttttctggcagctttcaagatttttttcttttgtcttcagttttaagaagcttaattatattgcaacttggcatggatttctctgggccttttctgttcagtgtgaaatcagtttcttgggtgtgtaggttgatacctcttgccaaatttgaaagttttcagcccttatttgcttgagtactttttcagctcttatttctcgtttccttccagtactccaacgacgtgaatattggaccttctgttgtagtccaacaggtccctgaaactctgttcacttttgttcagtctcttttctctctgttgtttaaacttggtaatttctactgttccatctttcagggccctgatcttatcctctagctctcctttttgtagccacgcccacccactgaggtttttattcccattatactgttcttcagttctaaaatttccatttaggtcttctttataccttttatttctttactgaagctttctgtttttcatttgtttcacgtacattcatgattactctctgaagcattttttatcttggcagcttcaaaaatcttcatctgataattctaaacatctctggtcatcttgatattggcatttattgattttccttttttcattcagtttgggtcttcctggattttggtatgatgagtgatttttttattgaaacggggacattttcatattatgttttgaggctctagatcttatttaaaccttctgctttagctggctttccctgacataagtccagcatgtctaggaagaggaggatactaacacattcctgccaagtggaggtagaagtctagctttcccacttggtctctgttgacacccaagggggtagggctccccattactgcttggtggaattaagagttccagttccccaaatgttctccactgacaccatggcgccgtgagcttcattacttgccagtggggaataaaagtcctggatcctacttggccttttttggcagcaccccagtggaggtgttgaagcacctggttataggtgggggagggagtctagactttccttgtggcctttactgttggggatgggaccacagttctgtggtattagttggggcagagtggttattatctaaatattttgtatgttgacaggctgcccgtttcctggtcctttggctacagtgaataaacttttgctggggccatttttgtttctaattggcattttcaggttgccaccttcttcagctccaagacatgaggcaaaaaagagaatccagggaactcaccgatgtcattcctggagtcttaattatctagccagtctgtgcgtttctcttcacatctcagagttttctcatgtttgctgttgtttttagctgtactttatgggaggaattggcaaaagcatctttactgtatattgccgggaagcagaaatcactcaagaatatacgtcttaaaaaatcagcctcccaggtgcttctcaggcaaatgttcatgaaccacactttgaggaacattttatagaatatgaaattgaggcccagagagaaaaactcaaaggcaagatgtcacatactcaggttgcacagcagagattctaaactagaaaccacatcacatctcctggcttccatttcaatgccatttcctccttgtggcacaatatcgaactactaagaataccaaaggggattaatgtaccaatttcactgtgattcatggagatcagtttgtagacatgcaggaaatgttaattctctgcaaatacagttattcataccttgatgtcaattgtatcaccctcagcggagacagtttttcagatgtcaccagtgttgtggacaggaagtctgtatttaggcagccttcagaagcccttgaactccctgaagtgaaatctggagggactggaaatggcatgagactgaaggcagcacgagtgcagctaatgaaatatgggcatcctccagtggctgccgttcatttcactggccccatgcacaggttgtaccagatggtgctctcatggtttccatcaatgcagaactgtgatgaagaaggggaggagaaaaatggatgagaaaaataacaccaatctgcacagctgaaaataattatgattacatggctaatgacccagggaattagacaaagccaagcttattggaactcaggccacatgcaggcaaatgtcacaatttaatgacaaaagatgaattgctttatctcctacatagtaactcatgatggggagtggtgattcttctttctgaatcactgtcttagagtaaagtcatgaggagacccacgtaatgagtgtcttctcattttgaaagggaattgaacctagaaaattaaaaaaataaagaaacttcagcaaatatgatatttatattcattttcacctgtaggagtagtaggcagcaacctacaagatattggaggcagtcttgttgccaccaaaatatagattatgtatcctttaaagagaaaggtcaaatcttactcttttgtggtcacttaaaagcatttattgagattctgccatgtacgtggccctgcttaacaacctgtgatagaaagatgaaaaaagatgctgctcctacccagcccagaagagttcacactgtataaatattgattgggggtggatgactgattgcaattccctatagagaccctgtcgaggtttctgaaattctgacttctttccattacagctgtgaaagctgataatcaaatgctggtagttcaagtattcattctttaattcattcactcagtaattctgtaaatcttcattgagtattgattatgtgtcaggcactgtgtgtggcactaggcttaaaatggggaaaaatgttttaatataattatattatgtgattatatgacatattaagctatgatctgtttataaaaagtacataatgcagggggagtcacaatgtttagaaatcagagatgaaatttttgactattagaaaggtttatgcaaaagagattgaattattagttccgacaaatgcattagccagtcagaaaaaaaaagtaaaacaaataccattaatattttggatcttaaaaagcatgtttataaaaatcgcattagggaagtgcatagcttagaagattggcaatgaaagaccaaacattttaagtgcatgtaattggttgacatctagccaaaattgataacaaatgcaactcatccccatctgctgatttatgtaaatgagttggtgatctcatttggtttgctaggagacaggtgtctctattgctgaagcagctactcagttggcacttagccccagtctaaagcaaaagtcttaaatttagctgtggcgtaaggctcagcttaaaatatggtccctaaaatcccaggacaagacagtaaggccagaactgaaaatcactgtaggtttgtgtcctgtctgtccaagggctgtctctgccatgacaagtacattttcaaactgctatgcatgcattgtctactggattcttccagcgtggaagttctgcaggaagagagcacgcaaagaaatttttttctgaatacttttaaacccacatttttttttgcgggggtgatggagtctcactctgttgccaggctggagtgcagtggcgcaatctcggctcaccacatcctctgactcccagattcaagcgattctcctgcctcagcctcccgagtagctgggattacaggcacatgccagtatgcccagctaatttttgtatttttagtagagatggtatttcaccatattggccaggatggtcttctcctgacctcccgatccacccgcctcggcctcccaaagtgctgagatataggcgtgagccaccactcctggcctaagtccacattttaataataccaagactgataagaccttacttctttcaggctctttcatattacagataataagagatgattatagataataagagaatgcatgtatttattaaaagatttgtagggatagcataccacagatagactatcagtgttaggagaaaccctaactgttagtgagcatctattattagtaaacagagaagaacacagactatgaagatagtctgcttgggtttgaatcctctattgttatttattagctgtataaccctgggaaaattgcttaacctttcaggtcctcatttcttccatttgtaaagtggaggtaatagcattacctagctcataaggttgttatgaagactgagataatgcatgtaatgcactaacaagagtgactagaatatagtgagtgttctacacaagttctctcatactactgtgttccagaaaccgtgctcagtaaatggaaaaaaacctacattatttaattctgacatcaactctttgatgcaggcatgacatattgccaccttataggtaaggacactaaacgtcagaatggcgaatggcagggaagaatgaaggtggctttttgagtttggctgatgctctatcaagatctttctattgtaacttgttgcttgagatcacacaggtaagtagtagcataagacagggagtgtaaccaagattcctggttctcagtttaatatgcttttttatacattacagagaattggaatactgtccaatttctgactttgtgcaaaggaaaaatatttacaatttagtaaagaatgctaatttataattccaaatgaaaaatgatgacttaatgcccagggagattaaatttctctttcttccaaaagttactaattgctacttatgtagcaaatattgagctaaatcctggggtcatagtggtaaacaatatgggcaaggtgattactagtgaatttttaataaattttaattactcaggttattttttctttcattcatttcttttatgatttttacaaaattgtgaacttggttctgattctgtaggattttacttataggcacaaattatacttgtccataattattacctagcacttaaaaaatgatcattcaaggcacttaaaggaagaggccactttcattattattttattggacattgctcagtaagatctgtgcacgttcattatccactcacaaatgaatggactatgatgtggttctaggctgacactccatgacctcatgagcttctgaaccaggtagaccataatgaaggcattcattagaggtctgtgaaccagggaggtggcacacattgaagttcccacatcatcattcatactaatctgattaactctcctactctcatttccagagtgcagggatcaggaattttggcaaccatctgggtaacagaagcccctccccaaggatctggtaaatttctgcccatatgttccctgtaaaattgcattgcctgcggctttcttcccatagctcatgtctgcagagatgaccaaccaaccagatcttgtggcaggccccgacagccttccaggaatagggcaatgttacattatcatttctcactgagacatacatgtgacttttattgccatattgataatatgggcattgagaaaatgacaagtacattggatcatgtaaagacattttgtgacacccaacttgcaatacattgttatttttaaaaggactttgcatcataggacatacaaaaagatagtgccactttctatcttacaggacaaaacctgggaagcaggctttcagaacatggagtctgatgtaattctctccaactggagaacctccagggagaaggagacatacgatgctgatttatttggattatacaacaaaggccatttttaataactaaaaactaaggcttgattcatggaattgtgattttaaaacaatagcaatcctggacagggctttcccctgtatgatttccctgtatcccaaggcagctcttggtaggagcattttatacttgtcaacagcgttcatcagctgaaaaataaatgaatcattccctcttttgaataactcaaagaaacatgtgcttagagtcagcatggtaccattttcactggttttcagcctaagctgtgatatttatcaccgtgaatttatcagaatatatatgaagcatgttcaattgtaggaataaatactgaaggtttagttcacttttgagagttggaggaaaagagactgatttctgtaagaacatttctatcttctaaatattcattcatagcctcactattgaaaggaagaaccacaacagagatcgtctgtagagtcattattataatctacctcttctgctcagacaaccagaaactcatgtgtgactagatgagaataggtaagcctggtcttcaggtcacttttgtctcatgacagagaaatacttcatagaaactagattttgtctgccgcagttcaacctggtctaacttgttgaaattctcctcctgatgatatctaaaactacctttggaaatgtacagatatgtgattgtgtgattttctcattggcgccattggtcagaccatagacctctaggggtggctggtacaccatcaggaagaagcagtgtgttacattggcaactatctgtagagatgtggtattgccctttctacatgttcctacctaaaaatgatatgtaaaaactttgcataatttaatttatgattctctcatctaagctatttcctcaattaactaacttcagtctggtaactttaaaaagtaggtttcatgttgtatttcaagttatttcctgtgctctggtattgcattttccttccattgcgccctaatatatagtcagttcctttcaatttattactgtcaatcactgtatgctgatgccctgcatcacataacagagaggaacaaagatttgaacacaagttgtaatttcttcactccgaaaactagatctgttttattctttactgcctagtaccttgtatcatttctggcaaatgctaagagcatcttctgtgatgaatgtttaaggaataaaggatgaatgaatgaacggattgaaatcttgtccctgctctcaaaaacctcacggtcaactttgaggaacgaaatattaaattattagaaactatcatgtaaatttttatttgatcatttcatgttttctattagaaaaacaacaagcattcattctattgttctaggcattaggaagattataaagatgaatgagatacacagtacaggccaggcatggtggctcatgcctcgaatctcagcactttgggagactgaggcaggtggatcacttgaggtcggaagttcgagactagcctgtccaacatggtgaagtcccatctctactaaaaatacaaaacttagccgggcatggtggtgggtgcctatagtcccagctacttgggaggctgaggcaggagaattgcttgaacctgagagacagaggttgcagtgaactgaaattgcaccactgcactccagcctgggtgacagagggagactccatctcaaaaaaaaaaaaaaaaaaaaaaaaaagagagagagagacacacacacaatacataaaatactagtatgaatttattcctttttgtgtgtgtggggggacgcgggtacagagtttcactctgtcacccacgctggagtgcagtggcaccatctcaggtcactgcaacctctgtcttctggttcaaacaattctcctgcctcagcttcccaaatagctgggattacaggcgcatgccaccgtgccggctaatttttgtatctttagtagagactaggtttcgccatgttggccaggtgggtctcggactcctgacctaaaatgatccgcctgccttggcctcgctacgtgctggcattacaggcatgagccactgtgcccagcttagatttaatgatgaatatggcatcagcaaaaaacaatcagaagactggacaggtaccatcattatgcaagtggatgtggaatcaatgattagacacggtttcttcctctaaggaagggaaagtcatcaactaacttgttctttgagtgcagtcattggaacacagactttagaatcaaacagacttgaataaaagcctagattcttacacttagaactatttgatattgggcaaattatagaacctctctcagcttcaattttctatctgtaaagtgagatcatgatgcttaagtgtttaccaggatgaaatgcaataacatattagcagacattacacttctgcccagtttctgatccgcagcgagcacttataaactattactaaaggaagtaggataaaaaagatttgaaaagctttcagaaaggaagtagcatttgcactttctaaaatgatgataggtttggatatgagtaggaaaaggtgtggagaggacagagaaaataagggaaagcattttcaaatgagaaaacagcagtagctgtagagattcaagaaatgctggtaatgtgccaggaagagcaaaaagactggagcatcatagaaatgggaagtggttacacagtgtgaaacacattagaatggctttacaagtttcgagaataaaacatttattgtaccctggagaatttagccactctatttcagagtgtgaactcctaaattaaggagaaaatgaccagatatcaggcaatctgtctccttgaaaaggtaagagcccttggaaaactacttatgcaatcatggaattgttgtgtggcggaaggagaaagttagaaggagagaagaggaagggatgcctaggaaaagatccagtccccagatttttccactgcaggagcattcaccaatcatctgcaaatgcctgtattatgacatgggtgatagaaaatttcttcatctcatcttttgattccggtacaggattttttgcagtacttaagtaatttgatttgaaataatctttctttctgtgcaatgcactttcagccacctcattaattttgatcttatggtcaataaagtttctgttatttctgcaaatttcatatctggttagtctcccggagttcttccctttcttttttccgtttttgcaagtacgaatccatgtcttaatgttcacccattccttccttccaatttccctcaagtcttatttctcctccagaaggtcttttctgcctataccaacccacacatttctcatcctccaatctcctatggattttattaaacttttttctcctttgccctttgcactatatatgtaattcttggattttagataagtaaaaatatatacatccttttgttcatttaaccataacttcctctgcccctcaaaatagtatgtattcaacaaacataaactgagcacctactatatgcaagactgctatatgtgactatagcagtaaagcaaatagccatgctctgtgctctcataggccttaaatacagtaagaaagagaacaaaaataagatataattaaattattggatttctgataatgataaattctcaaggaaattaaccaaatgatatgtttgagagggattgtgaggatgaagccgagtgcattagataggggatttagagaaaactttttgatgagattatgtttgaggtgagatctgagagataaggagtagatcaggcagtgatctaggatcacattacttcagggagagagaacaaatggaaatgccctccagcagattcaggtttacctgttggaggaatagaaagaaaattagtatggctggatcctagtaagcaagtgggcagagacacagaggcagaagggagccggaccatctcagcccttggtgcggagtttggattctgctccaagtgaaatggaaaggtagaggaagcttttaatcagaggatatacataattggagttgagttttaaaaagatcttgttggctattagacagtgaattgtctggagcagggacaagaacagaagcaaaaacattagttaagatgctgtcagtcagtccagactgctgtaacagaacaccacagactgaacagcttaaacaacagaaatgcatttcttaccattcttaaggttggcagtccaagatcagggtgctagcatgattgggttctggtgaggggtctcctcttggtttgcagacagctaccttcttgttgtgtccttacatggcagagaaaaagatcatctctcttgtgtcccttcttatgagggcgctaattccattcctgaagactccatactcatggctcaatcacctcctaaaggccccatagtactgtcatctgaggatgagggtttcaactacgaattttgcaggggacacattcagtccacagcagatgctattggtatagtctagccagaaataatgacgacttgcagtaggattgcagcagtggagttaatatattaaagacacgtatttaaagtaatgaaaggagccgtggcaggacatactgatggagtacaaattgagagtaagaagagtgagattaaggatgagtcttgtggtgacattactagaggggaagaaaaagtttttgaatttactgattagttgtaattaaaaaaatgtttttctaaataaaaattatgatagttctattcaaaagatatacaacttttacaagctatgctaatgtctacaaaatatctctccacttacaaattgttttgttttaacaatccctataatatatatcaggagttggtaaattttttgcaaagagctagatagtaaatactttggactttgtaggccacactatcttcggacagtacatcaatgtaaagctttacatcaatgtgaagtaccaatgaagatttatttacaaaaacaggcataggccatagtttgtcaaactttcatgtatatgatataatagaatgattgcctaagcagaatacataagtgcttctaattcatagaatacctcaaaaacatattcaacttagagatggcaacttcacgagtaattgaaaaatcaggcttatgggatttatggtcttttaaaaagccattttatctttcctcattaggaattcctgtaagcatctgattgtgttcaaatactcatcccaaagatgcatggtatagaatttggaaatctgatatgagccctttgattgaaatatttatctgttctcaaacctcaatagaaaacgaaggtcaaaaggcctttttaaattgggtggcagaggtgggatatttattgttatttttaattcacttcaattatttcaagtgacattttattcttctaatttcttttttaaattacccatccttgaaaagcgtcatctgaatttgacaattactttcctttttcagggaacagagctagtttctgtctgtgtctcatagaaaaatacagcccctatgttctaaaggttattaatatttacaacaagttgtgatgtattgaattaactgcttttatctcgcctttgaagtcctgataacgaaaaggacagaaagatcaataaccacatgatgggtaactaattgcttttgcttccacttgcaacctgccatctcactcagagctcaatccaaactccatttgacaacctcagatattgttttcaaccttagatctcaacagtctggactccaaattgagtactccaaattgagtagaaagacatgcttaaaaacttttcaatcaataattttttatgtgtatgtactactcaataccatccatatgggaaatttattagaagtaattactcagatgactataaagaactggaataatttatttgctaagagggatagtcttctaaacggtatgtaattacttcttttgttatgtttgtcatgatttaattcgctattgtaaagtcaaagcttcacattgaagatgctttcattaagtgcttatttagtaccactactactagctaacaaattttcatcagttgctataggtcatgttctggtccaaaggatttacaaaattaacttactgaatctttacaattccataaagtaagtactccttttttctacattgtgacatagaaaagtgtccatagcttcacggtaatgaatcctgtatttcccacttgccaatttcttgaccttgggcaagttcattcatctcttcgtaccttagtttgcccattcataacttgggaataaaaatcatgcctgcctcatcgagttattaagataaagtaggttaatattttaaaacacttagaagagtgtctgacatatgctaaagatagttatctgtaactaataagataaacctaacttgcctaaagacaaagctagtaaaaacagcatccttctgtacaagatgctatgaggaatacaaagatgaatcaacacggttagaagatctggcatatttattgacaagaacatcttcatggcaatatgcctggtttttactgagtgtgaaataaatctccattcttgtaaagtgagagagaaattatgtcacgaataccagtttatctctacaaatgggtaacaactcattgtggacccgagctgctgacaattaaactgaatgtatgagtcagtcttgcttatgttgctttcatggtttgcactggattacaactgctttcaccttcctcttaagaattcgttggtgaaagcaatcatagtaaggtggtttggatctgtgtccccaccaaatctcatgtggaattgtaatcccctgtgttggaggtgaggccttgttgggggttgggtcatgggggcaatttctcatgaatgggttagcaccatccctgctactgttctcatgatagtgcgcgagctcttgtggtatccttctctctcgcttctgctcccaccatgtgggacatctggctcctcctttgctttctgccatgattggaagcttcctaaggcctctccagaagcagaaggtgctatgcttcctgtatagtctgcagaaccatgagccaattaaacctcttttctttataaattacccagtctcaggtatttctttatagcagtgtgagaacagactaatatacatcagaagttgtttttccaaaattaaatatttaaagttttccgattaaagggcagattaaatttttgttcttaacttttaaaataagaatttcatgccaaacattgagcattcacagtatagttatttatactggttgcgaaggtcatttatatccctgtacttatacctatatctttttatgacccacatcttcaaacatagtatttttttgcattttgatgagtgattaattttaaagatgactaaatgatttttgcaggagtgtacatgcattgctttcccctgttctcatccaatgactctcctcaattttggtcagaaatttacttttcgctatctcttcttacatagacgtgtttaaatatttcattatcttaatttaaacccttaattcattcagttccaaatgtgagctgaaacttatttcttagctaaacgagaaatttacaaaggaaatgaaagataacattgcaaaaatgtccattcctctctccttcttcatcctcctggtatactgcttgtattgaatgttaatactcataagagagaatcccaccgaatccagtgaaccaggagaggtgtgagtttgcatctgtgttaggaatgagactttttcggttgattagcctgctctacccaggctgcaatgctgtgccacttgagaatgtttccttgcaaaggtgctaatgcagaaaaccagccaaaagccttttaaagatttctctgttatgtcccccaaatcccatcctcaaatgtggacaaattgatggtggtagtgttgggagtcaggcctaagagattcaattaagccaggaaacactctctacatagaatgaaatgtttccctgctcctctatattgagaacccagtgcttgacttacatagctattgcctcagaattatttccttcgtattgcaagtcctttaaaagctttctcagataaagccgatttgttctctcagagtcttgtacttttaacgggtttcatgctgttacgaatacccagacagaacttcccgttcaattccctgaatgaaatgttagatcgagacaattaaattccttttgtgagtctttgggaagtaatcttggacgaaagcagtggggaaataattactatagatcagtgggcctctaagtgcagtctccagaccagcaaaatcagtatcacctgcaaacttattagaacatgcaagtgatccagccagaccccaaccttactgaatcggcaactaatggaggtaggggcccagcaatgggatacacccacatttgagaacgtctgctatagagaaatatttcacagagacccatgtccttctgggaagtctgtgaaaaagctgttacatgtggttctgatttttgactcttcagcatgtttccagggtgaagaactattttaatttatactaatccttccaagtcaatcatcttctcagcataaaaccttcctggcattgccatacatcattttctaatgtgatatggccactgcctagtaccaaattatatgagtgattgtctctctcatttccatcaaaatgtatctgctttatttttacatctcctgataatattcagacatctcaatgctttattctttcatattattgtaggttttatttctcctattagatagtgagctttataaattcattggtgcattcagcaaaaaaaaaaaaatgtgtttctctcacattgaagcagaatgtatgggcctaatttggttcccatatctactctacagggcaagtgcattaaggcctctgagctttagttttatcacctttaaaataagggtggcaatatctggaggtaaacacttaacataatgcttagtatatgccagacatcaattttgatctctttatatgaattatgcaactcattctcactgtatacctataaggtagccatcattattattcccattttgtagatgaaggaagtgaggcagagaaaagataacttgctggaggtcatagagctggtatgtggtggagttgagaacccaggcagcctacggcccaataccaggcactgaaccccaatgccaactgctttgtaatctaacgccatagggttgttttgaatatcagtttccatgtacttagcacagggccagacatggcttgtgatatagacatggcttttgatataggatggctatttttaactccttcaagaaatgttcagcctatggaaggagaaaatgtgggaaaataataaaataatataggtatgtattagtaatcctattgctgatgtaacaaattaccctatacttaatggcttaaaataatacatatttattaatttacccttctggaggacagaagttcaaggtgggtttcaatgggttaaattcaaattttcaagaagattgcattttttctcacggctctacagaaaatctgttcccttgcctttttcaatctctagattttgcctgtattccatagcttgtggcccctttccttctgcaaagccagtaatgtcctctctgcaacctctacttccatctcacaccttttctgactctaactctcctgccttcctcttctacttttgagaacacttgtgattacattggacaatccaggataatctcttcatcctgatttataattgaatcacatcttctaagagccttctaagatcatacccccaaggttagaacatggacatctcttgggggccatttttctgcctactaataagtgttttatagatgtatgttctcacatgcacattagagaaagcgtgaggagtggaagtcaggaaggctttttggagaagtgatgctctaatataatgtttagttaggaatagttctttcaacagtgaagcaaggaggaacaaaaaggaattttcaagtcctccaatcctgaagcagccatggcatactcaggttgcagatttagttccagtgattagaagactgggttctggaggtggcagtgtgtggagctaaaactaaaatgagaagcagaggtcaggtaattgatgtcattgtatggcaagctaagggatttggagcttattggttgactatgggcttctttttcaatgagaccctgcagggtacatagacactcagtaaacaccgctgatgaacaaaccatgtaattgaattaatacagactttgatacaacatttggtcagaaaaaataaatctacccatgactctctctgttgtgagagcatgacttgagtaattgtttgatccctcttgtgttccactgagaagtggaagaacttttatcggctgagaactgccctaggcatccttagttacatactccagtaaaagcacttcgagttaaagcagcgatggctttctaaggccaaaatgtgctgtttgaggataaagtataagtcagattagaaactcaaaacctctgatggcacattaatgtgccaacgtggggacattccaccctatactttcactcacattcacagaatgatgcaagagaccctttaatccaaaagtaaacagaactatgtgtgggtgagataaggatgttcacttaatacagtggggtatctgcacaagtatctctgtgcagaggtgcttgtctgagcgcaagctgtgtgctatagccacagaagtaataaataaaatttttacctgtgcctgtagtccagcctattcaggaggctgaggtaggaggattgcttgagcctgggaacttgagcctgcagtgagctctgatcacaccattgcactccagcatgggtgatggactgagactctgccttaaaaaaataaaggaagccccaggagagaggtagacaggccttacaggccttatagacatgggcagagcttcttctccaataattctctcccttttatcattgcattcagtctctccaaacatactcatctcaagcatgtcacaacacattgacattctcatattttgtctcttgtctccaattctgccttttggttgaatcaaggggaatgctggaatttctagagtcgggccatcctagtctcatgtttctacctcagtctctgtaggtaaagcagacagatgggctccccttttcaaagaaaaaaagccaccctgcattcatttgcttattcattgacaaaatattaaccaagttcttactatatacttgtcactttgcaaggtgtcatgagtattgcagtgcaaaagatagaagcagtacccttgttttccctgagagtttccagttaatggggaaggtagaccttgtcaaaataattaagtaaaagaataaactaatgaccaccattgaatgctaactccagggcaggcactattcaaaaggctttaatctctgtagatccccacgaaaaccctatgaaatatagatgattactatttcaaccccttctccaagcttatagagttttaagtgttggagccaggattcagcttagaggatccacccatttctgaagagtgctcataagagaaatacattgtgcccagggagcctgccatcgataaaaatttaacactctttcagaaaatcagaaaaccacagtccaaaatcatggtgattcgttctataggcaggctgcatgttgcgtctcatcaccatggtaatgagatgcattccttgctaacctctctctagacctctgcagatctcccatccccaggggagctccttgaagatcatttatgagaatcagcagtaagcaccagtggcctttcagaacctctcagagagtgcttaatgcagtaattgtttactctgatttgtaatgagagagagtaacacggtgatgttagggactgattaattttcctgaatgtgtttcagagcagaaggcaccttgcagaacaagactcattttctccccctgtagattaccctgtcttgatttttttttgcagccgaaccccactggcacacctcaaagcacagcttgccttagctttgcataatgtaaaattgctgagataaattattatcacatgcaggatcagtgatcacttttttacctctaaattggtgaaagtgttgccatggaatcactaataaaaagaaagaggtccaggggttgctagttcatttagacgatctacagtttgatttcttccccttacaacaggcacacagaaagcagctagcatttaccaggtgcagagtggccattttgaaatagctaggaaggaaaatgaatactgaacacatgtagtgggccagagaatatgtaagatagctatgtttttataaagtagatcaaatgagtgtttggtaaagtggaatttctgagacgtgcgagtatgctcctaggggaaaaaggcttgttttgccaattgggcttttgttagaggccacagggtgtgttgctctggaactgaggctttgtaaattggcccttactagctgctttgtcttgtcttctaaattgcttgaaaatctattaagatatatgacccacataaaagtagcaccagaggctttccgaatcatggtccctggggattggattttactttatcacccattaacgcagaagggatttcatcagtcggcttacccttctctcatccccgtgggttataaaaattccaaagattagcctctctgggatataagcaaagatgtgaatacccagacagctgtttgacaggcagatatgctgggatttacagggatggcagaaacgtgggtcatgggggaagattagatgtggagtttgtggagagggttagtgagatagaagttcaaaatattagataattggactccttattaggaaggtatgaacagacgtttgttattgactttctgaagaggtgtctgggtcccgtttcaccagagcatcctctccaaggcatcgttttttcccatcctggcttctggggctcagtttaccttgctgtggtagcattttaaccaagcatacaaactcaaaatgaaccagatgcttaacatggtgaaagggggctgagtcttgctgtgtctactcaggcaggataaaggagaggtttgaactactagctggtgtatttaattgcctaagccaaaggtcacaaacaggtggcttgctggtcgtcctaaaacatgtttggattggcttgccctgtcttttgaaactcctgaatgaatggccaatatacataaattgggagattccacccaaaatagctagttttctaggtactcttgataataggcttctttgctccctgtgattagacaccctcctgctccatttctttctgttgcttcctggcaccagtgaagtattctttgtgtattattctgaagcacaccaactgcattgttccagcattttctcagtggctgtgtctgaaatatgatgaagggtccctcatgtcctgttttactgtacttgcacacctcccgagattactcacccttgatttcatccctgggtctttctgtgcctcagtgactcaatttgtagtgcactcttggcctcattccctttcccaaggatgctatggggagtataagagaaacaaagggtttgcaagacgccctaagctcccagggacaaatacaccactcagtccaaacttatggcatggttactgtttgtatgggcagtttagatctagcctctgagaggtggccagggtttctttcctgcttcggctgtattctacagagggatcataaggacccaaagcacactctctccctccgccccttttattcccagttctgcgagattggcagccccgtctcttcagccttgcatttattagttgagagatgattgccctccgtttatctgtgactgggttttgcctaaagaggatggcttcctgccaaaatgagatgcatgcctaatgaacttgaatgcctagaagcctgggcctcacagagtccctccatgtcaacctgcagccactgggaaaataaagattccagaaggttaatactgactgagtcaatttcttgactttagttttctatgcacataattcccctcacaggattgtaaattcttattttctctaaacagtgctctaggaattcagatagtctcttgttagtttcatcttttctagtattactatagtcttggtgtagtttttttgtttctttgtttgtttttttagaaaagggcaaatatgtgtgtgtgtagaagtgtggtacagtgggggagttttatattctcttacaatattgaagcaattcttctgtaagaacgaaatgaggttctttgagtttccaatctgggagtgaatgtcaagttcggagtccacaattgtgtctgactcaaaataggaaattgaaaaaacttgaagaaatgatgaccgcagagatttccaagctcaccttggcttcttaatcccagagaagattagatggtaggagtagaatgagtcctgaaaattgagtgatttcaggctgtgtaataccatgttgcgggctttacagaaacacaaatgatggtttgcaaaatacagtggctgccaaaaccaagtgtctgaaagatgacagattgtagcctgtccagttgtgaccctgagatgacaaagccagagtggccacctggcccattgttaactctttgatttacatgtagcaggcttcggctcatctccttagcaataaagtcccaataatgtggtccctgacctcaccctcacactgacaggtgccttttccgccagggcattcgccacacaccaggaagaaaattagtgctctgatgcaaggatttaccaaatgacctctctggggagtgtaaagagttaatgtcattttccaacctgcctaatttactctaagagggtattaatgtcttttgagcgaatcagaagccacgagtgcctggggagacaggactggggggcaaaattaaggaaaatacataaatgttaccccccttttccaaagtatctcattataatacatttacatataactcttttcttagcctacaagtgttttgacattccagcagtctttcaaaatggatcttttcccccctcccctttttctatttgcaacttctatggggtctagcagagccagcactgagaaccagcaaaccaggcttttactcttagttatgctgctatcttttgtccctgagctggtcacttctcagccttttcaactcgaaaacaaatgggttgagttaaattatttctaagggtcctatgctttatgatttaatggtttaaatgttttcaaaaatcaatgtttaaaacacttctttgaattacaacatattttaaatgcatgtagcatcttttctcctcattagggcactatctaaacataaatttatgatatcccctcatagaatacttaaaagcaaatgaagctggtggggtttctgggtcattttatcagcagcaaacacagcataactgtgtcaacctttaaccacagccacatttgacctctgaaaaaggcttgatgactgcagaactggccacccatgaccttctaactccattcaccttcaccctgtcctaattggtgatcccagtgcttctcagaaatccttggagcttaaatacatccaggcaggcaggtggggtctttaaaggatggctatcatcacagtacacaaggttttctcctcaaagcatgaaactccacaagcagttccaatatcgtgagtgagatcaggatcaaagaaccaagagaagggcttcttctctaggagaagattatttattttgttattccaaaagtgggcaatactttctgaaaattttgttctgtgtccaaaatttatataatctagttttctatagttgataatgcagctgcgctttaacatgctagtcataagccaggtgtgaacactcaatgtaaatgaattacgttcatgtaaaattaaaaattgagttcctcagttaccctagccacatttcaagtactcagtagtcacatgtgacacaaggctaccacattgtccagcgaagatcagtaacattcctgctgtcacagaaatgtctactggacagatctggaagaaagtggataaatgttcaaaccttcaggagctatttgttgtttccccttccatcattctttcaaaatatattaacttaaaaggagtaggccagaggctgaaaaaatcatgcagagtgctttcaatacattgtttaatttctctctttgaggtaagtgcattgtatctttttacagaaaagaaaactgagtcccaagatcacatacttggtcagtgcagagctgggatgtgtaaacagtctttcagattctaaagtctgtgttaatcttggataaaaattatttctggaatttttttatctagaaattgtaggaaaacagtaagtttctggactcaattatcatcacgatcatcatgattaccatcctcatcatcatttgtaagaagtgagtgagattttgtttttatattttggaaaggattctactttacaacaggaacctaggattttaatggctagatcacttcaaagccaggctaagacagagaacaggacaaggggaaagaaagaaagaaaacaaaagaagtaagataaaataaaggcaaacatgcatacgtaactcaaatgtttgcattttacttgtgcatttgtaatcactttgttttgagggctatagacttcatttagttccctatagagctagcatccttccagaccttgcaggtaaatataagagtgaggtacttgatatgcggtgtgtttcttctctgtgaatcaattcagctgagaagcaaagaactgcacttcagacttcaggcgttttattccttggcaacccactgtagtgatattacaaacattgaacctgttagactaatggaagtaaatgttgtaaaagctgtgaaagtcactggaaaatattcactcatttgtgcaaggataatttaccaagtacccactatgtgtgaggcactgtgctacacaccagctcgaaaaaaggtgacattaaaatacaaccccttcacctgaggggcaaattattggatatgggctgttacataagcaactctaaaatagtataatacaatcagcagtgtaggtaaatgttttatatccagctccttaggaaaaaaaagcagtatttgtctcatttgctatcgtcatggtgtaaataaatactcccactatgatcaatatcaggttaccaacataatgtcactaaatgtggagttggaaagagattgcttattgtaagcagtacaagccagatccagcgcactgtataatgtattatttatgttatatcatattatctgatatagtatatcatattatctatatacatatataaatatacatggatataatatatacaaaatataataaatgtaatataatttaaaatcatctaataccatgttaagaagatatagcctattggttaagagtttaggtttgggaggcctcacacctgtaatgtcagcactttgagagactgaggtgggagaatcacttgagcccagatgttcgagaccagcttgggcaacatagggagaacttgtttctaaaaaaacaaaaacattagcaggcaggatggtgcacacctgtggtcccatcttcttgtgccattgcacttcagtctgagtgacagagtgagactctgccttgttaaaagaaaaaaaaagttaaggttttgatatcagaccaatgtgactttaaattgcgaccattatactcattatactttatactcattataatcagtcagggattatactgactggctgagttctttaagcctctgttgtctcatctattcaatgggagaaaagctagtagcttcttgcctaggactgttgtaagggtcagcacagaaatgcttagttcagtccctgatccatagttaagtatttgctgatgtacaagtgagtaaatgagtcaatgtcaattggcagcatcgctggagtatgaagtaaatcgctgtaagaacctagaagaggacgaaattcagctcatggtaaatcagcaaaggcttcacatgaggaaacgtttgaaatgggccttgatggctaagtagaatcttaccaggcacatagagaaaagaggctcattccagatagatgcagtagtgggagcaattctatttgttgtagtggtggtggcagtttttctttaagaggtatatagtgccttagtctgatatgcctccttcttttcctaaaaactgctaggagctgctacacatctgcttctgctgttaggcaatgaatgccatcttccctaatacccactgagccccccagagataacagccatgcatcccttttcactaggtctttgtgagtacttctgtgaagaacatgctgactttttgccaatagcttttgtttactgaagccccagaaactggtgagagagatgtattaatgatggggcctaatctctattgtattttactgaaattccatttcagccacagaaatgccgaatgcctgccggtgaaatgtaatttcttgaagtatcacttattaaaggaaagcatatttcatctctccatgtctgaggtttattcaaacaaaggaaatgggttgttaccaaggaaagcataactcaaaatcccaattatgactgttaaaccacatgtgaaattacttttaataattaaaagtggctcttgccactccgcaatcctagttcaatattaggtctggtgccattttaaggaaagctaataatctccagtaaatccccttgaccttaattgtcttcacatccacccttcaatgacctttatcgctttgatggttaaaatctaaaataaatgatactaacagatctaatgtgcaactgcatcatgttcctttattttatgcatttgttatggttccattatacattttctccaaagaggcaagagtgttttgaaaaaaaactcttattacatgtattttttaattcaatttttaaagcagagagaagaaaatgtcaataagaaaagtgtcatttgggagaggaggtaaaacaatggaaggaaaaagaaactgaaaagggatggcagtacagaagaaagtcagtaattataaacttcactggcaaaatacaaatgtagcatccaaccgtaaagcctaagagagcaactaaagctatttctagaagcaacaaatttatgtaagtatttgcatcttgaataataatttcttttacaaaatattctaagatttggaaagcctgtagcctcaaggacagagtatatcttggctgcttaccacagcagtccattttgatatctatattttatatttaggaatattcttggattcacatttataacttgtttcttagagattgcacatgcagtgtagatattgtagatttaattgtttctcatattttaaacagttgatgttacttttgtttcattgtggtctacatttctgccattttgcgtaacgataccttattcttctttggaaaagttgctctgctctactatgcatttctttaatcaggcatttatttattcattcaaaaaaggtttcccaagcattgtattatgtgttgtaactgtatttgttgcttaaaatatacagaagacgtgtatatcatctgtccttttaaagagagtgtagggtgaagaaaggtggaagagagacatcatggcgactgataaactaaagaatgatataggcatatgtactgattttatggaaatatgtcatttatcagcatatctcgaaaactctgcctggttgagggagccatggaggaagtaaaatggtttccttcaggctcgttctgtgttttacatgaacgcaacctcgtaaggcagcactgagagtcaggacattgtccctgagacctggtcaatactgcttagggctggctgaagaacctctgtccatggttccaaaaacagccatcaattctctcttccaggagtcacacccacacacccatatacacatccaaaaatgcacacccattcaagcaactacgtatccattaaccttggtaaatgctttcttgcttgaaacaaattatttccctttttttccctatcactcttagaatgaaattgaaattcctaggagatttgtcttattccaagctttccctttacacagccctccaaccacactggcctccttcctatgtctcaaacaagccaggcttgtgtccatttaaggctttagcacaagctctctgtttgccttagtacatttccagagagcatcaaatgcttcaatccttcttgtcactgaactctcagttttaaacgtctcttgaggaggaatttgcttaatgatcttataaaaactatcccagtttcaccacccagtgagtctttatcatggtttcccttttaatggcaaatatttgtatgtaacaatttattattttattatttatattagtttattttctgtcttcttcaccagaatataaggtcaataaaagaaggaactttatctctagtattaatcctaaaaaccaattcattgtaaatatcaatgagatcttagccgtcatgggagccaggctccaaatggcccagtgatcctctccttctgctcttcatgttctggggtagtcagtcctttaaggctgacctctaaccaatgtgatagtatggaaattacaatgcatgacttctaacgctaggtcataagagaaattgtctacctctgttttgggttgctcactctgggtaaagccagccaccttgtcatgaagacactcaagcaactcatgaagtggcccccatggggaagaactgaggattcctgccagcaaccagcagcatgtgagtgaacatcttggaaactgattctccagccactctcaaggcttcagatgctacagccctggttgatattttgagcacaatgtcgtaagaggcccggagccaaaactaccctactaggctgctcctgaattcttgacacacagaatctgttggggacaatgagtgttttatctaagccactaagtttgggggccagttgctatgcaacaacagataagtagtatgcctatgctgcactaactgctaggtcttgctgggcacacagtaggcagtcaatatttgctgatatttaagtgaataaaggggtgttgaggaaaactccatttcatttagctgcatttaaataaagatgaattatagcttcactgcaagatacaggaagtagccaaatttttaagtgtattttacaaaagatgcctatgaagaaatcaatatcacaaacctgaatactcgattcaagctctggcagctttcttatttaactcccagttgatttgttttcacagagtaaattaccagaagggcatttgtctcattctctctttactaaaaggtctttaacttctatttgcaggtgtttttgccttctaatctttctcttcattgtttctccagattttgtcacgataacagatgtactttttgtattctttcaaatcctgccattttgcttaagaagaaaaaagatttaaatcaaattgtggttcatttgtgatactctccacagacatttataactgacaactgaatgcatcagttactttaaacagcctgactacagtcattcataacaaaacaaagaggagtgactagcataggactaactgatgagcagttctgtggagttgaggaaggttgtaatactttacatctacaacttaagatttcacagaagtctctgagacatatttacattacagattatgattcaaattttaaagcacaaggcaacattgtttggcccagctacttgattatgacttcttttcaatgtgctgttcccctgtaaacatcatggttgacgtttcaggcatttgcttcttctctctaccaaggacttgttttcattaacattgatgaacagctttcattttatctgtgtgtattctacaaaaagcaaaccttgtttgaaatttgtttcatattggaagaatttacttcatctcatagtcacagtgggcctttagctgccaatttaaaatgaagagacactttgcaaagtgtaagttattttattttaatgacattttatactcacgattcacatttttgtgcaggtaaaataggatatcattaagatcaccatcattgtgatatcttgcagagttaaattctctggctgggaaatgtttaagcctcagtagtttttgaccacaaattcacatttcaaaagaaaatatattcagggttcagaaaacagcaggtgcaaagggagttatagctatctcttttaactattaggaggaaaactaaaattggcaacaatagacttgtcattctctgcacttttattcttaatgataattatatgatgaaggaatacacattagcaatggcaatagagatatcaaattgtatagcattattgccaccattctaggaatagaaaagcagagtaagaagaaaaagaggcattagtgttatttatcattgatgagatgtggaaacatgagattcgcattttgcaatgcacagtgacattaaactctaatctagtgcagagttcctcagtagcaacattactgacatcttgggttggagaattcttcattgtggggacctgtcttatccaacataggatgtatagccacatccctggactctgcccactagacgttggtagcatcactgtagtccttactacccaaaatgtctcaagactttgccagatgtcccctaagggccactgctcttgtgtaccagataagtaaaaacatgggacattgagaagtggaagatctacactatctttaccgaaaagacccccatacatgggtgtattagttcattctcaccctgttataaagaaatatctgagactgggtaatttataaagaaaataggtttaattggctcatggttcctcaggctgtacgggaagcaatggcagcctctgctctgcttctgaggaggcttcagaaaacttagaatcatagtggaaggcaaaggggaggccagtactttacatggctggaacagaaggaagaaagagagcggaaggggctgtactcttttaaacaatcagctctcatcataactcaattacttgttaacactcatcaacagcactgaggggttggtgctgagtctttcatgaaggaccacctccatgatccaatcgcctcccaccaggccccacttccaacgttaggtattacaacttgacaggtgatgtggacggggacacagacccaaaccatgccaaagggtaactggcaccattgacccagatagtagcagagactcacacagctggaaggggctttgggagatatataggccatctttattttatgaatggaactctgcaactctgcaaggagcatagatttgttcagagtcacacagctgggttgtgtcaggcttgaaacttgatgttgtactacttgcatgctgttttttcttcttaactgaagatagctcatcctctgcaaatcttgtatttaaatcttctttattttctggaaaatgggttgggtttgcattatattagcccacgggaatgaccaattgtgcggcaaagaaaaaacaccgttctcatgctgaacaattgtctattccttctgggataggctgcagagaaaaagtagcactctcctctaggcaattgtctattcccactattcaagatggtgaatagtgggaaatctagatgttggattttgtgctacgttaaataactcctataagtatactaatgatatgagtttaaagactacaactttgacagatgcatgttcaatataaatgatgcaaaatccagtcattgcttgggttcaaatttcagttcaaatcactagctgcataaccatgggctaattaggtaacttctctgagcctgattcttcaaatctgggggcaaaatgagttatagcctaactcataaggttgctatatgtatgaaatgaaataatgcatatagttgagcacaatttctagtatatagaaagcactatctaaatgtaagtgctgttgctgctgctattgttgttataagtactattattgaatttaataactcaaaagagctaactctgcatagagagatgtgcagaatgcacgacaaaaagactttaaaaaataaagatgtatgaattaataggaagacttctcaatcatggctagaattaagatagacaatgtggagatgtgtaagaatttttattccaagaaaagggctttaagatataagatatctacagaattgttacagtttaaattagacataattacagaagatagttttaatgtgatgctgaaatatgacaagttaacacaagtctgtgtatgtgaatttgaaaagtatatgatttttatggcttttaaaaattttattcattgaataattcctaaatgccaggcaacgcccttctccatggctgacagcctgaccaacttgagttgataatgagactcaaatagaatgcaaattgcctgatattgtcgccttcaccaattcaacaatcatcccaatcctgggactctgaaatattaataaaatctaataaaggactccaacatgccctacagatggaaaagaaatgaaaaaatgtcatgccttctctgtgaatgctttgaaatgaaaaatcaaatgatcggtgggagagagacacaggaccaacaactgacggactgtggaatattttcagaagttttctattactccagatctattgctgataattttaaaaagacaatattgtcaatttcatgtaatcatgtgtcactgtacatatgggaatatctaggtgcataacgtggttgccttactatactacattggtatccacttgagagttcttggctcttgatttttatgcgaaaacatagacccagtgttttcaatttgattccttagcatgtcatcgggaagccttgatactttgcaataaactgccaaaataccatactgcacttatatgtacacaaaggcacaatgtattatttaatattgtttttaaaaagaaaaatatatagttaccatggtattggaatgagcaacaattgagatcctgctgttcagtgggtaaaatgccctgcttcacacataataaatagcaaaccctcattgtttgtcatcttgtagctcattgtcctgataatttctcaagtggaagtaaattaatccatccccccctttaaaggatatagtaggctggaatagaaagagcagtgggtttgaagttaaaagagcctaatctaatccacttgccagctatgtgaacttgaataaggcgtagtttttgaatctgtaaaatagaagtaaaaccatcgatcctgcctgcctccctgtgagacgcacgctgagaatcaaatgtgattgcacatatggactgttttgtaaaataggaagcatggtacaaaggtaaagtactattgggtggggcaagggacatctacattgtctgtcactagggtgcagacatgtctgagcatgtctactggatgttggatcaatcctctcaggagtctatttgcataagagacatagtgtctgcttgagtagaagttataataagagaggactgtgtcaggcatgccactctggagccagcaaaattaaaaaatatatatttagtcacttgagaaaagaaattattttgaaaccactagcaacagctctcattagatttatcttctggccccacattttagcctcgtgtaatagtctcatagaaggagggcaggggaaggagctctaaggaaaaactagtacagcatgtaaggtattagggtagaagcagcaactcttagagactatgtatagaaagtgaaactgtaaatgcagagagaggcatttttctcatgtgttgcaatggaacatcattcagctttgacaactcagatgttccagtttatcattgacacggtggtacctggcagaacacatcttcccaggttattacaaagaatcttggcaagcatctgtgcaagaccctggcaggtgccaaatctatctgatgtagcgcagttcccacgtaggcaggctccgcatctcacagcaacctctgctttagtagaacagccctgacatccaggttcaggctatctgtagctatgtctctgctatatggacctgccttttcttattgaaatctattatttgtggtagacatctgatccaggcagagaaaataaggtttgcttaagttacatttaaaagtaatctaattcgaatttttgagtaaagatgttgtaggaaaatacaggttcttgtcacacaatcagaaaagattaggctcatggacacacagaagggtgagaaaaatggaatttattgggcaaaaaaaaggaaaagagaaaaactctcagcagagtgagagggaagcctgtgaactggctcctgccccaccacataggagctcaagaggctgggttcccggcagggagcttgcatggccccaccccatcctctgagtgtgcaggtgggcattattcagaaagaatcagttgggaaagggtggacttcatctggagccagcagtccagtttttcaaccttcaggctgttttaggcttgaagttgaggttttgcagggagtccttggcctcctcttgcatctatcaaagatagagagattgaaagtcaccaaagtgtcctcacgttaatattagggctccagagtgcagagtcttgttactaaatttcttggggcatgcccaattgttcagttattctcttcgttctcagtacaatgctggcattcttctaatataaatttcatttaaaataattaatttgaattttgtctgatcaaaagaagtttaatacctgtgggaagaggactttacaggtaattagacattgacttggcaagtcggaggaaaagtcagcgtaatatgaatcacttatgacaatttctgtcatttaacagcctgcagtcatgtctttcaatgtagtacaccatgatggttaattttatgtcgacttggctgggccacattgcccagatgtttggtcaaacattatcctggatgtttctttgaaggcgtttttttggatgagattcacattcatatcagtggactctgagtaaggcagattgccctccataatggaggcacaatggtgggcctcatccaatcagttgaaggcctgaatagaacaaagactaccctcccctgaataacaaggaattcttccatcacactgcctgtgtcctcagacttcaactcttccctggtctctagcctgctcactccttctcctggagatttttaacttgcacctctacaatcctgtgagccaattccttagaataaaatctttatttctctctctctctctctctctctctccctttctctctctctcttctctctctctctctgtgtgtgtgtgtgtgtgtgtgtgtgtgtgtttactctctctcttgctcgctgtctctcggtttgtgggtttgtttctctggagagccctgaataatacatacattgttacctaacaagttggcagagttatccagcacctccaaaatatcagttctcagcctctttgttgtaagtttggtgaggatcaacaggcaacaacggagtcagagtattaaaaataaatagtagattttataaaaccctcaggctctcttatctgtactgcagactggaatgtgatctcttcatgagtgagtgtgcacccatatgcatttccaatttctatagtaacaaattaccagaaatgtattggtttcatgttactgctctggagaccagaattctaaaatttttctgcaaggctttgtttcttctggaatctctaggggagaatctgtttcttctctttccagcttctagaggccacctccattcactggctcatggccccttcctggtgtcattctgacatctacttctgtcatcacatcttcttttttgactctgacccccttgcctccctcttataaggtccctctgtgatcacattgaacccatatgaataacccaggattagctccctatctcaagatccttaacttcctcacatctccaaagtccctgtattagaagcgtttaaaccagaacaactccatcttgaataggagctgggtaaaataaggctgagacctactgggctgcatccccagacggttaaggcattctcagtcacaggatgagataggaggtcggcacaagatacaggtcataagaccttgctgataaaacaggttgcaaagaagccagctaaaacccaccaaaaccaagatggtgacaagagtaacctctggtcatcctcactgctacactcccatcagcgctatgacagtttgcaaatgccatggcaaccttaggaaattaccctatgtggtctaaaaaaggggggacatgaataatccaccccttgtttagcatatcatcaagaaataaccataaaaatgggcaactagcagccctcagttctgctgtgccatttttttattcctttattttcctaataaacttactttcattttactctatggactcaccctgaattctttcttgcataagatccaagaaccctcttttggagtctgaattaggacccctttcctgcaacacctatgccatgcaaagttaacaacccacatactgtggattaggatatgggttgcccccctttgaaatatggggtcattattttgcctgccacagtgccccatataaaacggtggtcctccatggatattatggctcagaaaaaaaattgaggactacttttttctggaaggcaaagaagagagaatccattaatttttttgtcctatatcgtgttcaaaatttagacccaaaagcttcctctctcctaatttaggatgacagaagtaatgaaaaaatatcaaaagacagaagaaatatttctaagagtgtagattactaattactaagaataagtacatgaacacaagaaacagagcctctgttcatgtggaaactaaattgttagtaaagggagagaaataataaacaccataaattgggatacatttcgagggtggaactgacagaatttgtcggtaaattagacatggagagtaagaggaagggaaagattatggctccagtcttactcaagcatctatatgcaaggcacagcaccagggactacaaacaccctgatggtaaggtggagatcaaatcacccttcaataatcaaagtttatcagggtcttgctatgaacaggagcaaatcagccaatggccaatgcatgtttgaagagatgcttaaactcactgctcatcacagtaatgtaaattaaaattatgagacaatttttttcataaaattggaaagaaaataaatagtaaaaattaacagtatgatgaaggtgcctgaaaggctatctcagtcattagctgtgtttcaaaagagacatcaaatcttatattattgaagttgtagggaagcagatactttccacttatttttggagagattggagattggttttagcttttcagagaaaaatatgtttctatgtctcttaaaattaagaaaaaaaatccattaaggaggctcagccattacacatttaaatatgaaagaaaattacggaggtgtacaaagagtagattcagagggttcactagagtatcatttataatagaaaaaaatcagaccaaatttaaacagtttttaagagaatattgattaaatggactgtctgtatccatataacaaatattcttaataaaaaggagttaaaacacataggtgagcaaaaatagacttagtattatataacttatgcccagagtctttacaaaacaaaactacatacatccttttgttcacatataagtaggatatgagttctgttaaggatggaaagccacagagagcattttccttacctatattccttaattattgtaaaatgatattgtatcaatgttgcatttgtataattgaaaattaaaatgatgacaaaaataaaaaggagttgagtggttcagtaggaacaatggatagcaaagacttactgtgctgcacggctttacatttttgccaaagcttcgctcactgggtaagcccccaattctcctgatcatttgttgcttttcctgttgatgtgaaaatcaggcattttttcagacaaaaggcagtagaacatctttgaaatgaaaagcgacataatggcgcaatacttaagggttttattcaactataagatcaatataaatcaacactatgatgaggtttcttgcaatgcctgccttcatcactaactacattaaaagagacatcgaatcttaaaaaagggaagaaagagaactctactccatgctgcttacacagtatctgcagtgttatatcaaggtgtgcacactatatttgaatcatgtgcaaagaaagaaagcatggctattaaagggcttgaaacaatgtcctatggttaatagtgaaatgaacagggaggcatttaaccaggagaaaaaagtactcaaatgacatatgatggttgactttaagcattttaagactgctacatagaggacaaaaggagctcattctgttgacttgcaaaatacagaaactaagaactactgtttcacaaaacactgacatgtacattgtttctcattcttgtgagatattattgtcctgtttgacagctgtgtcagagaccaaaaaagtttgtgtttcctttttccataatgttatctctgagaagtggccaccagccagggactacattccctagccccactgagctgtggccccacgattgtgttccagtgaatggaacagtagtggaaaaattgggacccacttccacaggcgacacatttacacacacacacacacatctcctatgcaaatgctttcatatgctttttctctttcggttagcgagaatgaagaagagttgtagtacaaactaggaaaccaaagctaattataatggaggctccatcagcctggatccttgatggactgcaaggaagagggcagccctaccaacttgttaatccactttgtagtattatatactaataattcaacttctattgaggccgagccattatacactttgaagtctattgtcaaagcagttaattcattgaacagattcagaaagtaaaactcagcaggtaagtgttgagtctgaaaacaattacactatcaagaggttcaattaaactcaaacccaggccatcttattctgcatccaaaaccttttctcttgtaccatcctgctatacaacagaagtagaatcaatgttataaataaaaaggacagagattatggctcaacataaaagaactctgtaacaggcctattcttgcatttctttaagaggcaatgtgttctccatcgcaagaggtgttcgaaaggaaacattagagaaagaatccaacagcggatgagtgtcagaggtagatgatttaatatttcttacgacctcagattccatgattctgtgcacacttgaagcactcagatgatgtttattacacaaacactatgtactcagtagcaatttgggagccctgtggtctccttaacaaggtataatgggagtgctaggaactgagccagaaaaaaaaatgaatgagaactttcactagaacaaggtccaacaaatgtttcatttggaaaggttggtaagattgagattgacaaggaacttgattaaaaacatataaatgattctttgaacaaataaaattcttggataattcattgactatggaagagcttacacaaatataagaacccatgcttatgactatttgttgatctcactgcgataatgttcacctccagaggaccaggagaccatgagtaaggaggtaaaatgtcagagcagatttctttggttgataatgggtggggtgacatggggatgagggctgtaggaggcagatggtgatttcaagtttgagtagcttgtcaagaggttcttataacacatacggggttgggtttgagctagaaaaatagcaagttcatttgttctcacaactcctaccctccagtaaagctgactatggctgccacttctgcttccactttgtttcctagagggcaaaaccaaaaaagaatagaagaggaagaaagagggtattgaggtatgcataaagtagacgtagctcaagttcaggtgactaagatttttgacttaaacagttattggcgtttgtctagacctcccccaataaagagatagatgccaaaactttgagttatttatgccagtgctatatcaaaattctgaagtgatttattcattcaacaaaaactttgtaaccccttactgtgtgtcagacactgatgtaagtaatggagaagcagtaatgagaacaaaacaaatcactgccactgccttcccagagcttacatttcactggtgaaaagagacaataaactaaataagtaaaagaatgcattttgagtaatactgataaatgcagaaaaggaatgtaaatcaggacatgttggtggaaattttagaaaagctagctaggaaacgctgtactgagaattggggttctgaataaattcgggaaggcattgatatagtgagccagacagagagttgaggaggctccttgcaagtagaggaaacaacaaagcccaaggcattaagctgttcctggcataaaagagctgatatgtctggagcagagggcactagaaaaaaaaaagatactagaaagattgcaggaatcagaattaacaaagcctgaaggtcagagtaagaccttttagtctggctgcaacgagaaccctggagaagcttaagcaaaagattgacaggctctaacttacttgttaaatgaattactctagctactgtgtcaaataaatttggtaaaggtggaagcagggagattaattggatcattgcaatatctaggcatagtggtttggtctgggatggtggctataggaccagtgagaatgagatgaattctgaatatgtttgaagttagaactgagaggatttgctgatagactaaatatagagtccccatgtgatttttcttgtgtctattagagtctgagaggcactgaatgagtctgagagagagagaaagggctaaggatctatagaatgcttgacagggagcagtaagggctaacttgagattagggatgaattttaagtaagatcaatcaggatgttttgtgtcttcttcagacaccttcgacagtgctagaggaggcactgaatacatagaaaggtaaatttaaccagggttttggttttgccatgagagtgagagaagcaatgcagttgcaagaaagttgactataatcatagataagctgtaaattatagtagtaactgagcacaaagtataagcagagtaggaagggaagagaaaacatggttggtgggagtcagtaaaagacagtgaaaaattgcttggattgatgcattagacagcaatgcaggggttgaagtgctactggaatttgggcatacaaggagacagctagagaacagtatgcgatgcgcagttgataaagaacaagattaaatacatggcaatgatatggtgtgcctgagacagagtgaagagcaaggtcactggagaagaaggggccaagaaaataaaaggagggcattggaaggatcatctgagaggctacggaaattataaaaaattacaacactggtaatgttgaagtgacagtgtatcaggagaaaacaatctctaaagaaaaagagataggctgggcatggtggatcacacctgtaatcccagcactttgggaggccgagtggggtggatcacgaggtcaggagatggaaccatcctggctagcatggtgaaacctcacctctattaaaaatatataaaattagccaggcgtggtggcggtagcctgtagtcccagctacttgggaggctgaggcaggagaatggcatgaacccggaaggcggaggttgcagtgagccaagattgtgccactgcactccagcctgggggacagagtgagactccctctcaaaaaaaaaaaaaaaaaaaaaaaaaaagaaagagagataatgacctgagaatggatgaaaaataaggaagaatgttgggtgatatgtagtcaaatgagatgggattcaatgctgactgtttatgctttggacaggaatggtctagaagtgtcagtggagagagataggacatctgtcctgccaccagatgccatgataccataggagagaaaagaaccactcactaagagtgctgcagagaaagatttgccattagaggagaaaggattttgtgtgagcaagaagtgaatgtttgctgatgaggttgagaatatcagttgactgagaattgacatagagctccatatggccccatgaaaggttattaaagatggggagggagagataagggtcagaaaaggcaatgggaattaggggtggggatctggaggatgagcaacaatatgaagcacctggacaccttgtgacattcagcctaaacagggaaaggggcatgatgactagctccagtggtctcaaggcagatggaataaagaggcttctagtattgagggggaaaagggatgaagaaggcccttgccagaaagaagaattccgtggttcccacttagccaatgccattggagacaacacaccctgctgaaggatgatcttcctctgaggttgtagacacctgcttggcctttgctgaatggagcttttttagagttgggttttctttttagcataggcactctccaggcctacgcatatagcagcctgcaagtggggtgttatcacaaaggcatatttaactcagtgtaactaactgatagtggaacatcagaaaaaaggaagaacatcagaaagagagaaatatacccaaataaactaattgcaaggaataaaatatgggtttagttgacagatatgttggtcagtgtgcaaaaaaaaaggtagaatagtccattataatagtttattatacctgccagcttccttgttttggccatttgtttactctccgtttttgacacctgcctcaattacttgttgtgactctgtcgattctgatgttgcaataaacctaaacattatgactaaaactaaatattttgtgctttttttcttctttgcctcatactaaactcagccagaagctgaacactctcatgagagttcccagtatgatggagaaaagaaaaaaatatgacaagcactgcttgtcaatagagaagcaaaatagaacatgccttttttggggggccagaagtgccacctttagatgttaaatatcatcccttcggtcaaaaaagatgctgaaaatctttctaactctttcaaactgtgctttcatcaaactgtcaggacttccatagatagctgaaattccaaatcaaaaacctagcaagcagtttcatcgtctgtgttcaaatctcagtgggactttatagcactttccttgggagcaaaattcatgtgtctgaagctcagcttacatttcatgttgaaaaattgcaatgaatacaatgaagtttcttactgctacataaaattgaagcaccaaagagaacagtgtgtatttcacaatgtttgatatagtatttgatcataacttgagggaatcaatgaaccttcaagaagaaactcttggggatcctcatgcagcaaattcaatcatttgttcatcaactcattacatttctattgtacactagccatgtgctgggctcatcctaaggaactaaacaggctcttaaaatgacggtctgtaggcgtaaaaccttttccattttaataagtaaatataagaaaaatacaactcatgaactaggtatttcccaggtttaattcagaacatcatagtgtcaaaaattgtagttactaattgtgcatcaaaacaacaatgccaaaaaaagagataacaatcttttttgttcttgaaaaactagcagattaatgtattttgctacttagatattatcagaagtatcgaccagactactttaagcaacaaaatgacaacaaaaaatcaaagagtatattggcgaacggaactgagaaattcagtacacagaacttcaggcacagcttgatccagaaaatcagcattctttttctcttcctaaacttctcagcctttctctccacagtgtcttatccttattttccccaactattagtacatttcttttaagaaaatctggaagaaagcttctgagaactcctggctcaaatcatcacaaattagaatacaacattaagaaaaaagtgtattccctctcacctgctgccatcatctacatatcaatctcaggaaagatgctaatttcacctctgtgagttatcttcttaactttagaccaatcacttttcccaggggatgagatattagctaagccaaagactttgtagccagaagtggccaatggactgtgattgatatctcttcagaagcaagggagtagttagtacccccaaaaggaatgatgatgaggagaaaataaaagcaacatatattcactatgcccaacctggcaacaagaattgaagtaacctatatatctaacagatgaaattatttatggtacagctaaacagcagactgctatgcagatactataattatcttgcaaaaatatgtcatatcatgaaaaatgttcacaacacatggttaggtttaaaaagtagcttattaaacagtagatctaatagaatactatttggataacacttttgtattacaagatgaaaaatctatatattattatgtatgcagagaaaaaatactataaggaaatacactgaaatgctaattgtggccatcctttggaggcaatgttatagggatattttgttgttagttgtgcataattatgttaactactttttcataataaaatgtattacttttgaaatcaaagaaagaaaaaactatcatgtggaaatatacacctaggagtttggatttatttccaaaggaaaatgtcgtggtgatagattccttgcaataattttcatagacacacaacacgagtgtgtattagttcctcctgaggtagaatcacaaagtatttgctcttaggctcttgatctgagccctgaggaatcacattttcagttttattccaggcatgtttcagaaatggcaagatgagatgaaagaaagattagagtcatgtctaaaaattggctttactagggcaagtaagtccttcctgtatagtgaattgtcattttgaactgtaagacatttttttgaagaattctttaaccacaaaaacaaagattttctttttgtcgttttatagtctcaatttcagcaaaatatagtgcatataataacaaacagatggaggaaacaaaacaacaaaatattcagtgttaggccagcactgattaaagcttaatattttgtctgggggtctaaaataatcttttcagagaaagtagttgtcaaggcagctggtgtaaaactgtttattctttttgtcatcttgtagagatgttaaagcttccctattgcagtataatgcttttaaatccataaacgatccaaggttttaaaagatgtacatatattagatctgaatttgttcgaattatttataaagtggagagatggttagcattaatgaaatgatcctttcagtccttgcaaattgttcccatacctctttctcatactgaaatatttactgagtttctgtgatgtcactgagttggttgctatgggaaacccatacaagatcaggaagtgttcttatttgtagtaagttcattctattcaaattaggtatcctttggaataggaaacgttttcagccattgtacattattgaacttttattttgtctaccgtgtacaaagtacctgtgagatggggatacaaaggtaatgaagttatttttatacatatgaaggtaattatatttttaaaagaattactatgtaatgcaatgtagctaagataataatgcaaaaaaaacttgctatatgagattggaggaaggaatttgaaatgcatttagctgcaagtaacacaaaagtcaaactacactgacttagttaaacagattttttttttcttatgtaagaattggagatatagtaattaaggaccagttcaatagcttagtgctgccagaaatgatgcctccacttttctcttggccttttcctaagacttagctcctctgaatttcaagatggctactagaaatcatatccacattgaaggcagagagaagacagaggaaatgaagtagaaacaaatggatcttttccctttatcaagaaagcaagaattttctcaaaaatcccagcagacctttcacttacatcatgtagtggatatgtttcccttcccaagtctttttagtcaatactggggcaaccagtgtcatgaagttgtgaccgaatagcagcccatttagcttcattgtgtatctaacagtttctgcccaggcatcatgaacacagcttataggaaacctgtggaaatctgccacttatggacaaactggagctatgaaaaattaacaacctatgagaacagtccttggccagtggagaagagaagccaataagtaaattctcgaccttttcatttcttgggcagatgatagtgaggctttgtctatacagtccctcaaataataccagtgtaatgggaccccacttgccaacaatgatgatgattttaaaaattcacaatttgcaggttccataattttctgtttctttcttagaaaaagaactgtgtgagtgagaacttatttatgatctctgagatttcttcccaagaatgttttctgcacacaaatccttttctcgggctctactttctaaagaaattcagactatgacacttctcattggccaggcctgttttatatgactgctctttatttcaagggaagctatcagactgagtatctagttgcaaacatttttatctaatcaggaagtagaagtaagaggtattgagagaagatttaacagagcaggttatgcttaaataggtctttgtagattaactaggagttttcaagaagtgaagggataaggaagcttttacaaattgtctatgtgaaaggatcagcatgaccagcactggagagaagtgaaagtataaggcttatgcaacaaatgacaagctggcagaaattccatttgactcaaactatgagtgaaagaaagaacagaatcataagcaccaacaaaatgagtctggacaaatagaggcaggtctcattggatgggtcttgtggcttttccataacctttcccctttagacaatcttgaatctttaacaaagaggtggttattcacttaatacatatttatttcttgcccacaaaagacatgtctttatctagccaccaagaatacagtaatgaccgaaaagcacaattactttcttcttggagcttacacaataaacacaccaaacgaataattcgataaataagtaatacaatgacaatcagtgataaatgctataaagacacaaaaaaatcaggctatgagaactgagaatgatagaaagccaattttaaacacagtaagcaggaaggaatgccccgagaatgtggcatttaggtgaagggctgaactaaacagggaaagaattatgtgggtatctacaggaaaaccattttcaagagaggggacatcaaatccaagggctctgagacagggccaagctttttgtgcttggagaggaccaagaaggcagggtaagtgggaaaaacaatgatgaggatgagtgttaagaggaaatgtcatgaaagcaatgtggagactggacacacagggctttgtaggtcaatggtgaggtgcttggattttattctaagtgtgttgggaagagactggataattttgggcagggggtaatgtgatataattagatatttgagagattgctgtggctgctgggtgaagaactgagtaacacagaggtggtgtaaaaatgaagcggaaagaacaattaggacagccagtagtataggtgataaaccatggtagcttggtaaaggatactaacaatgtagatgctgagtaatgaatattttaaagataggcttgcaagaacttgccaataatctgtatggagtatgagacaaagagatagttggtgatagcaactaaaatatgattccacaatgaaacagggctttaagggctctctatatattgacaagtcgtcatgacaacctcatgaagtgtcactattattaacatcctcattgtacacacgagaaacatgaggtacagggaaattagtgagttgctaaggccatgctgctagtacttaaaacggcaggttttaaagccatgcatctagctccaaagtcatcatctcaaccacaacactatttcgagatgcctactaaatatcaatggcaacatggagtagtcagttgtatacaccaaagtggaactcaggagagaagtcaaggtcaatgatacaaacttatgaatcatcagactatagatgttaaaaccatgggacaggatgaaatctcctagggcagaggttggcaaacttattctgtaaagtccagatagtaaatattttaggctctgagggccatattgtctccattgaaactactcaactatgccattgtagcttgaaagtaaccatagataatagtaaatgaatgggtgtggctgtgttctaacacaactctctttacaaaaacaggcagtaggggaagatctgccctctactcctagtttcccctcgtggtttcaaggaataaaggtggttagagaagtgacagggagttggaactctctacgttactgatgggagagggctgcaaagaaatcatcaaaggagactgaggaagggaagtgacagagggaggaagaaaaccctcagaaagaacaccaagaaaagaaaagatatttatcacaagaggccaagagtgtggccagagggtagaatcacagaatgagagaagtaaaagggactttagtcttttgttcaaagattctaatttttgtaaataagaaaactgaggctcaataggagaaaatgattttcccaaagtcatttcaagaatacaatacatttttctaaggcatccacgttatgatgtttctaaggcatactcaaatattatatattttagcttaaaatataaaacaaaattttgccaataatagcatcaccctgaatgagcacctgaacactgcattctggttcaacaaatactggctgcacaactgctttgtgtctacaagagcatctggctctggagccacggagattaaagatgcagtgcctgtcttcaagttacttgtagtctaaaaggagaagtggaaaaagaaacagataattgcaataacttaagatatgtttttcaggaaatcctagccaggtgctatggactgaattgtgttgccctcagaattcatatgttgaagtcctaacacccaatgtaatggtatttggagatgagggttagatgaagtcaggagggtggagccctcatggtaagttaagtggctttgtaagatgaagacagaaagattgatcttccatgtgaggacatagtgagaaacagcttggccatctgcaagccagggagagtgctctccctagggactgaattgaccagagccttgatcttggtcttcccaggctccagaactatgataaataaatgtctgttgtttaaaccacccagtctatggcattttgttatagcaacgtaagctgactcatacaccaggtgagccttgagagcacagggaaggaaaacctaaccttgtctgagcattagggacaatttcctggaggagaggatacctgaaatacctcctccaaactgtgtcagtgcctttccagtatattcctatattctctaggcttttcttcatcacaacacacattcttcctaattaagtgactttgtgtttatctatctctccaccccctcttcccacaagttcctcgaagtcagggcatgattgtttatggccacctttgcgtgccctttgcaaaatacagagtcagtattcaataagctacagtttattgaatgaacgaaggcatgaaaatttgacttggtaaccccaatgaacaaatgaaggataaattggaggtacccaggcaaagaaagaagaattttgatacaaaaaaacaaaacagcttaaagaaagacatgaacctaggaagcaagtggtgcattcaggaaatgacaggtagacctgaataatctgaagtagaaagttgaggactgagaaacgtttacagcgtgcttataatctatcaagaaatactctgatactctgacttattgactatattaactccagtaatgctcataacaaccttttgatataagttgtattataactccattttacagaaggggcaactgagacaaacaggtgttgagaaatttgctcaagattacacaaccaagatgtagtgaagctgggagaggaacccagacaatcagcctctggagtcctttctgtgtacatggacttgagagagcactaatgaccaccttacgcagacctataaggccaggctaaggagcttgaatttttgtaagtagcctactggaagccatttagttatgatagctacctggtttgctttcatttaaagtaagatttgagaggtgtaagactggagttgcaaattttcagctgagacatatcaggaagccaggaattataaatgaggagacagatttcataagtatttgtggggtaaaattgacagggctttatgccagcagagggtgaagaatgcagaaataagatgagtcaagggatgatacttaggatgatggcttaggtgacaaggtggatggtgaggccattaactgagacagggaatccaggaagaaaaagtgacaggggaagatgatacatttagatttccctatgttaatttcaaggtgcctgggggcaatcacatgcagatctccaaaaggcagttgaatattgaagtctgagactcagggacaggcctctgttagatttaaaaagtcgagtcatcagcacgtaggtggtagttaacacatgagagcaatgagttttttattgtaaaatttatgtgcacgaatattacctaccagtgtgtgtgcacaactttggaagcccaattatcaaaagccttcctctgaggccttctcaattagctgaatctgcaaaatatattacaagatgctaaagtagctctattggtttcagcctctaaatgtgtccccaaagtcctcagcaggaaagaagtaacagagtttgcttttacaaatgcacttaaaaaagcaaaaataaaataagataaatataaataaaacatctccccttccaaacataaatggtgtccaaggagaagttgaattctgatggttttcttccatgtataaaattaggccacctcagtttgccccaactctatatttttggttgtcacttataaaacctttgtatgtggcattgcaagagggccttgaggagtttcttacaagggcagacttaattaacgtttccagctgtgtgcaacttctcaagccccaggcagtgaagaggagcatactaaataggaggccaacctgtctatctccattcaagtttgataacttttttctttttaatatttttttacattttttttctactatgtctaagaattagctcaaggtttaataacccttgatctcagctcaggaaagtgttgaatttgggtaaaaacaaaaagtaatgttgaaacccttcatcacccttccatgattcatttctttttcagacattttccaaattttgggctccagtcgattcttgtgtattacgctgtgagcaagacttgcatgtcgtcacagagaacggggcactatccctgataaagattgtgggagttggcttcctacagcatcgatcacatggctttaacccacgagcaagatggctgaagctgaagaatgggctggatcacaaaaatagattttctgtctgaggtttaatatgctttctttctttctttctttctttctttttttttctgaagactgagtctagctctgtcacccaggctggagtgcagtggcactatctcagctcactgcaacctccacctctgggttcaagtgattctcctgcctcagcctcccgaatagctgggattacaggcacctgccaccatgcccagctaattgttgtatttttagtagagacggggtttcactgtgttggccaggctggtctcaaactcccgacctcgtgatccacctgccttggcctcccaaagtgctgggattacaagcttcagccaccgtgcccggccatttaatacactttcatcattatactcagtttccagaagggcttcttggagttaaggaacatgggtttggaaatcaagagatgggtttgaggcctgatgtaatggtgatttgagtgtgattttgaataagccattttttccattaaggatctccattttgtctttggtaaatcaagaacagtgcaacacaccagacttactgctactgagtcatttagttaccgctgcagagcaaaccgtccccaaaatcaggggctttacacaactatttcttgttagagttcacgcaattgcaggtcagctgaggtctcttgttagatttggcttggctggggtagctatgtgagacaactccgattcgtctctcattaatctcctggaaccaatgggctagcctgagaaatgtccttctcctggtggtagctaaaacataagatcacaacagaaacacaagacagctcttgaggtctaggcacagatcaggcatatattcactctggtcttattctattggccaatgtgagttacatcgttcaaatcagagtcactgcaagggcacaaggcaaaggacatatgtcccagcatgcataccaggaggggtggagaattggagccacccctaatgtacaacatttaggacaacagttaaaatacaaaagtactttgcaatcaaatttcaaagaagttcagttaatcaaatttatgtactcatcttttacctaaagtttcagcatttgtaaagtctctaactgttcagatctacactgtttaattagctgttctaattgtttcagaagtacaatattttttcatgacaaccaccaccaccacagaacaccttgcatttacatgaaccaacaaaaatccttgttattagaacaaaaaggttttttttttttttaagtaggccgatacaagatggtcaaaggatatacaaagacaatgtttgcattttctttgtctgttagtaaattacctggctgacccctgcttctgaagaaacagcacttttcttattctgtccacatttgaagagaggagatcattgatacttacttgcccactctaatcacaaatgcgataggtctaattctctccactttgggatccctgcatcattccggagacaggcactgtacctggaccggcatggttaaacatcactcagacatcagtgcaccctcccatagcttttatctctgagctgagctctctgtgcacaaagtgcttgtgaaaggacagaatgtcaaagacaggaacaggttgtgcatttctaaagatagctggagagagtttaagcagcatgtatatttctatccttattcacagcttgtgtatcaagcttcatagttagttataagcattttattttaattaaagagacaaacaatgacccagtgagagaatttctttattttgaattttgtattttcttcctgctctctcagcctgccattctgacggtggagaaatggatatgggcagttcagccacctcacaccatcacactctcttttgagagcggtcttggaaaccagccagattgcattgttgtccttctgtcaattacaagtgtgccagacacccaaagcattggggaggaagtgcaattattagaagctacccaagagactatcccaatgtcatccctgacttgccaggtgacctttagaaaatcaaatgtgtaaaagagggatgataaattgttctctaggccaatcatgcaaatgagtagaaacaccaaaggagaaaaaagttagggaaaggagaattccaaagaaaccaatttttgttcatggaagaactgtcttctaatacaaagagaaccattcccaaataatgggtaaaatccttcccccagatattggtcataatttaccaacctactcctgttcatgtctgttaatcccaaatgccttcttcctgccaaaacccatgtatctaacacctattttttcatttttggtgaagcgttaatggttttataaaataacttctaagattctttaccccaatgccagaaaagcctttattttcccttggacatagggctgtggggatgagagtgagaacataaatgggaaagcagaaaaatctatttatttattattcatgtgtctatggatatagcaactctattggcctggttgtggtctgacactgaagggattatattttcagagcaaatattaaagggagaaattattcttagtcatcaaaggattggccttctaagaatgtgtcccagtaagaaatactttgagctacataaagagttgggtaaaaagaaagccatcatgaattgaacaccaactatacacccaccactttctttgacatcttatatatgtatcatttagtgagaaacaaaattacttagaagttaaaatcaaatgcaaaatgaaagtcactggctaaaattctctaccatggacagagccaatctgggcctccttgtatattgttcttgaaggaccttggataagttaaaattaaatgaaatattggacattatcaacaaggcattctcttagaatgatatgtgtcttgcatgttgccagattgtgatgataattttatatgtcaacttaactaagaaaaggaatgcccagatagctgataaaatgttatttttgggtgtgtgtgtgagggtgtttccagagaagatcagtattttactcagtagactgagtaaacacagttctccctcaccaatgtgggcagccatcatcttatccatcgagggtccaaatggaacaaaaaggtagaggaagggccaattatttctctctcttcttgagttgggatagccatgttctcctgcccttggacatcagagcccctggttcttgggcctttgaactcagagactcaccccagagctgcctctcatccatcccctactgctcctccctggttctcaggcttttggccttggacaggcagttacaccattagctcccttaactctcaaacctttggactttggctgaattacactattggctttcctggttttccagcatagagacagcatatcttaaaatttcctggactccataaccgttgtgagccaattctcataataaatctcctcttatatttctgttatcccattggttacgtttccctgaagaacactgattaatatactgaccttcactctttacatttgtatactaaaatattgtaactcaattttgaagctaaccacctggagttagtgttagactccccatagattaaaagacacgatccccaacgagactgccctcacttcagatgtgaacagcaagttagagggtccccaggctacctgtacttttgatcaactggctacaaaactgggatgttcccatgtcccctcccccagctttaatactatttaatactttaatgctagaatgactcacagtattcaggaaggtgtcataattacagttttattttaaaggatacaatgtaggactagctagagggagagacacatagatgaggtcttcgagtgtcaaatattcagaacttctatgcacttttctcatgggatcagagcacatcacccactcaggacgtcagtgtgttcatcagccatgaagttccagtaagctttggtgtccagggtttttactgggttttcattacataggcaagtggattgaaccaaatctctagccacttctagcttcccaagctcaaagcctctctaatcacatggttgcctttttttggtaaccagtccctaacctgaatcatctgctttgcataaactcaagtgtgatccaaggcacacatgaataacaaagaaactcctatcacttgggaaatttcaaggattcagagtctcgccttcaggaaccaggggcaaaggccagccatattcttcttatatgatgtatacttaaatttacatatatgcataaatgtatgtgtatcaattatatatgtattatattgtgatatatacactatatataatatataaatgcatgtatatataaatgtatatgtacaaataaacataaagccatctaatgtccatgtgtttttgtatctccttcatgtacctatacagcagtcccctctttcctgcaatggttatgtgctaagacccccagagggtgcctaaaactggatatagtattaaacactgtatatactggatacagtattaaacactgtataaactggatacagtattaaacactgtatatactggatacagtattaaacactgtatatactggatacagtattaaacactgtataaaatggatatagtattaaacactgtataaactggatatagtattaaacactgtataaactggatatagtattaaacactgtatatactggatatagtattaaacactgtataaaatggatatagtattaaacactgtatatactggatatagtattaaacactgtataaactggatatagtattaaacactgtataaactggatatagtattaaacactgtatatactggatatagtattaaacactgtataaaatggatatagtattaaacactgtatatactggatatagtattaaacactgtataaactggatatagtattaaacactgtataaactggatatagtattaaacactgtatatactggatatagtattaaacactgtataaaatggatatagtattaaacactgtataaactggatatagtattaaacactgtataaactggatacagtattaaacactgtatatactggatacagtattaaacactgtataaactggatacagtattaaacactgtataaactggatatagtattaaacactgtatatactggatatagtattaaacactgtatatactggatatagtattaaacactgtatatactggatatagtattaaacactgtatatactggatatagtattaaacactgtatatactggatatagtattaaacactgtataaactggatatagtattaaacactgtatatactggatatagtattaaacactgtatatactggatatagtattaaacactgtataaaatggatatagtattaaacactgtataaactggatatagtattaaacactgtataaactggatacagtattaaacactgtatatactggatacagtattaaacactgtataaactggatacagtattaaacactgtataaactggatatagtattaaacactgtatatactggatatagtattaaacactgtatatactggatatagtattaaacactgtatatactggatatagtattaaacactgtatatactggatatagtattaaacactgtatatactggatatagtattaaacactgtataaactggatatagtattaaacactgtatatactggatatagtattaaacactgtatatactggatatagtattaaacactgtatatactggatatagtattaaacactgtatatactggatatagtattaaacactgtatatactatgcactattttttcttcttctttatattttcttggatagattttttcttcacatacatcttagcaactgtagcatacgattttttttcttgtcaagaatttttacctttttactttaaggaagcactttaaggattctatttggcatattcaaattgacagcattacaactcttgcactttggggccattattaagtcaaataagagttacttgaacacaagcactgtgataatgagacagtcagtctgataactgacacagctactaactctccagtgtcaggtagagtatacagtggggatgtgctggacaaagggaggattcaaatcccaggcagaaggacctggatggttggagatttcatcatgctactcaaaatggcacacaatttaaatcttttaaatagtttatatttgaaattttctatttaatatttttagaccatggctgactgcaggtaactgaaactgcagaaagtgaaactatgaataaggggacactactgtatataaaacttgaccctagtaataaattatcaggaagaataaaaaagaaagcagtgaagttatcaaagaagaaacaagcctaatcaacaaacacaaatagtactacaatttttccatcagctggaacaaatgctaggcagtgtttcaacagtcccactccatccaaattcagttatttgctagaaggacccagaatacccaaaagcagtttgttctcatggctaaagtttattataacaaattatacggagtaacaatggtagggaaaacatatgcatcaggcagattccatagatgttgggaataggtttagagtccttcttcatctcaggccacacagaacaggctttttctccaacagccatgggaagattccctggaatgtctctgcccagggaagcccagtgaagtgtcagggcctgaaatgttcacggaggctggtcacattagtacactcttctgtgccaccagagagggcgactgaaactcaggactccaataataaaatcaggttcatgtcatcaattttgatgtttgtgcaaagcaattctgtcgagttagtatggcatggtctattgcttcagatatatacagcaaaatcataaatcattaacataaagaatcttccacatactatcttcccagggttttgccatggttaattatggttctaggttccaatggcgacatgcaaggagcaagctaccagattttctgtgttaactcctcagaaagaattaacactattgcaacctatgaactcctgaaatgcgtagacagcatgaaagccctaaaattctaagcaggtgagatcgaaaatctagctggatttgaacaagatagggaccaatatatgaaggtaagtgtctcacatcattaataagagaaactggaataaattagcctctaaagaagacatgaagaaaaatcaacccatgatctcctcttagttgatgaattacacacagtttcaaccaatgcaataaattcttttgctcttgttattctgaaggattgtatagcaagctctcttgctacctcgctttaaaaactccggtggtctccattacaccttgattactggcaatccaatgctgcataattttccttcagcctctccctctaacattttttagtgtccctgttaccctcactgactacatcctgcctcactaccttctctcagcttcccacacatgccaagcttgtttcccaccgaggtgcccacgggataactcttctctttgcccttctttatggccttttcttggttggcctctccttatctcaaagatttcaactaaaataccacttctgagaaatcttctctaataactcagtcaaaagtagccccatttctaaagctttctctatcattttacccagttttatttacttttgtgcctgaaagtcacctaacacttcctcactttacatatgtctatttatttatttatttatttatttattttatgactaaaatgtaagctctctgtgagcagatactttgtctaagctgcttcccactttaattcctattgccagcatttggctcagaataggtgttctgtaaatatatgttgaaataacaaattaagagtcctgtaaagtctgattttaaagttgattgtaaggtctctagcccagggctactgagagcattttagtccatgtatcagacttatcccataatctgagtgattccaagtgtcataatgagataattgaatcgatgtggctcaacaagtggtccacagaacaattgaattagaattacatgttgtctggataaaaatggaattatacgaattgttcttcctgaaatttttatttagtaccttaaactgcagctcagaagtttgcattttaatgtgtttttcagtgattcttaagttcactaaaacagaagctctgactaaaatcacagtgatgattgtctataggggcagtggcacagtaagtaaactgcctaggatgcataacatctaaatatatgacagtttttggttatggcaatcaaaataacaaacagaaggagattcttcaaaaataagtttattcaggaacgagcattgcaataggaatacgcatgggtgttttcagggaggcaaaagaagataaggatttttaaaggtaaaatgatgagggccacataagtgtttctgaaatagttatccctggctacaagcatgaataaccaggattgcctcagtctaaggcaggacaggcagttgctgggcagatgtccttgcagaagtattttttatgtcggtttgcagtggccttgtgcacagtcgtggttttggcagaatctttcatgatagctcttgttatcaggcaatcatgtgtgagaaccctcccttcatggccttcttagacaccattttgtcaggatttgacccaagtgactccattttaattctgacaagtttcacagctctgagcgagaatgaccatgaagcggatcttttttttttttttttaaagtattacttgatttttgaaggtcatagggcgcagtgtagtcctgcctctgactcttactagatgtgaaaagttgaatttttaagcattctaaattccaatttcatcttctgtgtagcaagagtagaaatatctaacttgcagcatactattttttaattttttttaacttttaagtgcaggggtacatatacagctttgttacataggtaaatttgtgccacaggggtttgttgtgcagattattttgtcacccagatattaagccaagtatttattggttatctttcctgatcctctccctccttgtacctaggcctcagtgtgtgttgttctcctcaatgtgcccatgtgttctcatcatttagttcccatttataagcgtgaacatgcggtatttggtattctgtttctgtgttagttaggataatggcctccagctccattcatgttcctgcaaaggacatgatcttgttcttttttatggatgcatagtattccatggtgtgtatgtaccaaattttctttctccagtctactattcgtggtcatttaggttgattctgtgtctttgctattgtgaatagtgctacaatgaacatacatatgcatgtgtctttatgatggaataatttatattcctttggatatatagccagtattgggattactgggttgaatggtagttctgcttttagctctttgaggaattgccatattgttttccacaaaggttgaactaatttatactcttgccaacagtgtataagaattctttttttctttgcaacctcaccagcatctgttatattttgactttttaataatagccattctgactggtgtgagatggtatctcattgtggttttgatttgtatttctctaatgatcagtgatgttgagcttttttcatatgcttgttggccacatgtatgttgtcttttgaaaagtgtctgttcatgtcctttgcccactttttaatgtaatagtttgtttttttcttgtaaatttgttaagctccttatagatgctggatattagaactttggcagatgcatagtttacttgcagcatattttaaaagataaatgagataatgcaaaagacttagcacaatgcctaataaaaagtagcttgtggaatggtaattttaaaatgacaaggttttgttagtatgatttcaagtgggcagaaaccaaagaccttctaaataggcttactaagtagacagaaagctcaggggaaatgatacaaataaagacagaagctctcccattgcttgcaaaacacacgtgagggcttttatactgagggcaacataactattcagacttcttatctggctgtctttcttattagactttcttatgttactttattcttattatttatgaatactaacatcatttgggtcaaaaaccacacctttgtggtgtccatttcatagtacttatcacattgtactgcagaatctttcaccctcactaaacatcctaaggtagagaagttgtccatttgtgtttatatctacagcatgtgttacagtgtttgacacatactagatatacactacaaatttgttaaatgaagaatgaataatgctcaaagaaacatttggtctggactgtcttctgatctgactggggactccactagaaagccatgttcttgagaaattagtaatgatagcctttctttttcattttaggaggtttcatcctctcaggattaaactccttccaaattaagaataatgacttaaacccatgataagaacttaatgtaagtcacttttctctaccctagaagtaaatacttttaaattcagaaatccaccaggcatttttccatgcactgatgagtgccatgatagtaaattaaatagcagaaatagctgccttcatggatctatcattttagaaacaaaagaaaggacattgtgttcttagaaccagctcatctttctttctgcctcattccctacctctctctctatctttatagtagttgaaaatgccaaaatgtaggattacattttgtcctttagacattctcaacatttgaaacttgtatgtaagaaacaagtgaagaaatgatcattaaaagaagagagaaaatattgagtaacctttgtttaaatttccacaaagcctcaggtttcattgcaatataaaagccactgaagtaatgcttgtttgatttgcttagcaggagcacaacacgaaaattccttgagcagggaagacagctggtttgccaaatctgcacatttggctgtacaactggctctattggtagcttcaggctagcaatattttttactgacaatttacatgctgctccagcccaaggtatctgaaatgaagtctttgcataaacacagttagaaaagaacttggctcccaaccctggtcagaactctgctttaaaaaaggaattcacactgatccatggtaatgtgataaggttgagccttttcagcagagatttgctatgcaaggccccttgttttatatggcattatgtaaaacataatgtcaataatccatattgtctgtcttaataccattattcacataacagtattgtgcctacctcagccgctttgtaatccgggaaccccacacgcacattaaaacagagataactgtggaggaacacggttgcatacaagttgtgttgttctggcagggagttactcctctgctcctctcagaaaaagcattttaattccttgggatttttttttaagattaaataacatcattttctgggatctccaaatttccagctgcttataaggctgatttcatcaaactaattaaaatttctttgtggctaatcactttagggcttagttaacttctggagaatacatgaatataattgtaattttatctgattttactctaacatggaattaaataagcatattttaaaccatatataagaatggtatatgctgtcttagggcttgcattccattttgttgaacaattgattatccatattatccttaggtcccagggtacaatgtgtaaatacatcacagcaagatataaagtgaactagaaaaataattgaattacatagaaattctctagggtggtagcaatctattatatccattaaaattcagagattgttaaagcaatccgaattatcaaaactatctttaaattgggagaatagcaaattgttttgggggaggttctgataccaaagattttatcatttataaaaacttggaacaatcacagacctaaataaaaattagaagtacagtaacagaactttctcctgaaccatttgagggtaaattgccaaccaaatgccatgttaccacctagtagcctataaacaaagacattccctccatcacctcagcacacccatcagagtcaggaaattagaactgaaaaattactgccatctagtcctcagatctcattcaagtttcatcaattgtctcaatattgccctttatagctaaaggatccaattcagaatcacaagctgcatttagctgtgatgtgtctttaatatcattgagtttgaccttgacacttttgaagatcacagcctggttatttttaaaaccatccttcaatctgagttcatgcaatggtgcttcatggttagatttagatgatgtgtctttagaaagagtatcactgaagtgatgctgtgttcttctcattgaatcctgacatacgttgtgatttccatgggtttatttctatttgttcattttggccacttgatttagttggtgccttccaattttccccaatgtaaagttactttttccccttataattaatatttattttattgggagatacttaaaattgtataaatagctcattcttcataaaactttcaatgaattcttttacttacatttgcatggactcatgtttcctgttttatccaattgtttaaaatctattgctatgctcatttattttcatgctatatggtctcagatttggccaatgagaattccttctgtctggcttctttaccctcttgaccatgttttttttagtgctttcatattttctggcataatgagatgttttaggattactttgcactttccctttctcagccatggatttaaccatttcttcatggagctccagaatgatatttggaagccaagatctgtgtgctaaatgtgcttattggtattggagtgttcccatttgcaggcccttgagtgaaaacagctatgcaatacacgaatgcatacacaaaatacattcatgtttttatctacatttattcgcatctctgtcacatatacattgaaaaacatgagttcacagcaatacctgtaatttcaatccaacatcctagagttccatctagtttttcccctttccatatttgtatatccatgtctctgatagtgagaaaactatatcccattatttttaattgatttgcttatttgatcaatccctctgcatctaatatcctgcctttgctgttaccttctctccaacatgaatgccctccatgccctactctgacgccatgattggtgtccctgtatgtgaacatggtcatcaccctagttggccctactatctccatcagaccacccttctgcactgatggccttctgaacccagccaggcttcaacattccctgcagaatttcctgctacatagacatcctggggcaccttcactagaaaaatgtggctccctcccattactgccacagatgtttactttgttttattctacataaggattaagattaaattgatatacaggaaaagaaacaggaaaggagggacaagggaaggggagggaaagggagaatgaatgaggaagggctaagacatcctttcaaatccaatttatcccaatatattattatatattggcaatatacaacagaatgtcataatgcactcacatttaaacatgatcatgtgtaaaatttctataaccttggatgctcccatatgtccctaaaaaagatcaaatacgtgtttttcttgagcttgtaacattaatgagtatttaacttactcacattgcttttattttgccagctcagtgtcaagaattcatttagatggcagacatcaatgtgcactttaacactaaaccatgaaaatatatactcactagagtaagtccaagccattattcagagacattttaattcccatagttcatgttgatatctatctcaaaaatatcaggaaacaagtcttcatttttgcaacattggtttgttgtcataggtaaaaaataataattaagagcaaacagatactgccataatttaaagtaatatgatttattttcaatggacactagcatgttataaagcaatttacaacatcaaacaaagccataatgtttcagaatgggtcatttagcatattatattatggcactttacttattatagctttgaaactattatgaaattttctcagccagcacttttttctttgcaagaatccttgtttttttaatgttgttcttttttttttttttgcatttccagtgaattgaatctgtttcaatatttaatcactgtctgagtttagcaggtataaaagatttatggttttatctcattattaatatatttacatagcgcttttttctttattagtgcctaggctgaataaataataataataataaaataggtaagaaaaggagaggtgtcattttctgtttaattctcctagattgttgaatgagatttttggatgaaacatacatcaattttagaatataattagatttgaatgtgattagtgccaacttcatgctgtctaaaaaagagtttatttaatcaattataactgtttcttacgaagtcaagttcttgatttgtgatttcattttattgtgttcggagacccttgctaaatatgtcattaggagacaaaagctcaaatccctcggccttcttactacagtaatgtttcattttaatttaaattcaactcataaaacatctctgtccttttataaacaaggtgaaaagataagttcaattcagcctactgaaagcatgttcctagaattaaaatactggcaaagtattttagtcttcctctcaacacatctggcaagttttttagtttagttttgttttgttttattttgtttttttgagatggagttgcccaggctggagtgcagtggcacgatctcagctcactgcaacctctgcctccttggttcaagctgattctcctgcctcagcctccctaggagcaggactacaggcacatgccaccacgcccagctattttttgtattttttagtagagactgggtttggacatgttcgtcaggctggtattgaacacctgacctcaagtgaccctcccgcctcagcctcccaaagtgctgggattgtaggcatgagccactgtgcccggccatatctggtaagtttgaaaaaaaaaacccagtcacggagcccattcagttacctctggccctctgctgtccccatcacagctacttggaatacttgggttactttttgattcataagcgatatctcatcatagtcccgaattaaccagctgttactgatggaggcttaaaatcacgtttagcaaacctctacctttctcaacaatcattgaaacagctgtctccaaatctgcatacatatcccctatatacttcgtggttattgttccattttgaagggttgtcattttaaaactaaaaactaaaagacattttttttctctaattctttgccccccaaatcttctaaacgtgtgtaaaacattttagccataccacagacttcatttggtatttgtattgtggctggtattagtgcacaagaaatgaaatactatctgagaaagtgttttgtaaaacataggactttgctactctttagaaatgggtgaggatttgaggtgagtgagattgtggtattcatgcagttggtagactcaaatcatgctggctccctgctgaggaatcctgggtcctgattcagctaggttgcccagctactttccctcttctcacttcaatgttctctcaggacccgaggagaaactgaaccttatttccaatctttcttgtctcttccaccagatgcttgcttaaattcaccaacactatgacctattttctcgggaccttctttcctaaagctacagtagagtattccctgatgttgtattaaaggatgctaacaagtgaatggatgcaactgtattaatggggtcagatgcaaagagacaccaccttaaatgacataagggaccctaatagtggccgtttcaggccaggtagaccaacacttggaagacaacatacttctgaaagactcaactttgctgccaataatgaaagccagtccaaataggaaagatctttctacacaaaaactaatagtgttcttgttcaacagaacacagttgtgtgcccagctgagtcaggagagccagaacgcctaggttcgactcctgacttcgaaaaaactctttcgctcttctgtgcctcaacctcctcatctgagaaatggagaatcaataaattagacgtgtaaggacaatgtcagaagctattatttttaatggcagaataacgtatttgttttaaaaaagggtgggggacgggattaggacaagacccaatacacaaatcctggccatctacgacaattggtgaggtgttggcaaggttgcttttctcctcagcgccctagcatttttcatgtgtaaaactggaactatcatgatacctccttcatagggttactagaagattaaggaaatacatataagaatatcatcatctgtcccatagtaagagcatgacaaacattagctgtcacaatagaaacacctgaattcaaatagtattattgtactttattaatcaaggtacccaaatctatataaggtagagaataacaataaatatttctactgaatgcattacactatttcttttagcccctgctttttacttgctttttgaacaaagtaaaaataaatcaagtaaataactctctttttaatataaaaggcattacaccaagagcaatatggataaggaaaaaaacaggtgaattcattcaaaatgcattaacttcagaattggttctgaaagggctaattgtaaaagtctctttttacatgtgttgtgttcacaggtggtaaacactgcactaataaaaaaggaccccgtgcgaagcaccgtggatgccttgccagaacgagtttgtgtggccatactaacagctgaagcattaagttctcatatcgggttagaaagcaacttttctcccaattaaggagccaaagaatatttctgtttcctgaaagtaaattatgacccataaattaggaatttcaatgaaatatttaccattgacatgaacaaaaatttattttatttttattttaaattcattttagtggtagactggaacacgaaagacagacactcgtgatttgaaggcttccgttcgcagtgtatacattacatttgctgctggactcaggacaataaaaataatttcctgttgctgctgctggtactctactacaactattcatatttcttccacctagtattgattaatcttttatgatggactagctaggcactttacatgtattaacacatttgattatcacaacaaccctatcatggagactctattattaatctcattttaaagataaaaagactaaaggaccaaaacattgaataccttttccaaaggcctccagaagaaaacatcagatagtctgactcaagagtattcttatgctgtaccacatctctatattaaacttgaggcattctgaaaaaaattgaatattgttcctattgaattttttttctctcttattccttctaactggacaagaacctatactttcaagtgttgtatgtgtgtatgtgtgtgtgtaaaatttatagctcgagacaatgatgtctattttctatttaatggtatgtgaaatcagctggctgtcttgatctagtagccgagacacaggtgctcatattacaaaataaatagtggcaaaaattgaatggacatttacggtagcaggcactgggaagagagaaagaaaggtgaagacactgtaaattgaatgacttcaccttagcagaggtctctgttgtctggcatcatgagttcatggaataagtctgctcttgcttgctagaaggttgtctctatctttcttaatgaatgacttgatagatttcttaatgaatgacttgatagttgtacaaaacgtgcaaaaatttgtcctcgtctcaaaaacaaaaagaatggcaagatagagatggaggatgagatagcatcttttggaaactatcagcacctaattagtcctgaacaaaggtagttgtgaggtccaaaccctcttgtgccctgtttttctacaccctcatggtaattggtatgactttcacaaattacagaaaaagacacccatttgacaagggaactgaaggtggtgaagacatactggcaggctacagcatttcaacccaggggttaattctgaaactctctcaccatcaatgtaaaatttttcatctatgaattcccacgtacaaagaaaaggaaagggaaaggaaacagccttcttagccagggcaatttattagcattgctcaggtccgtgcaagaatgtaaactaggacttttgtgaaacgtcttgtaatatattcaaatcagttcttccaaatcctcatgttctttttgagctgatttagttgcacttcgctcctgggaaaacccaggaagagggtttgtgaactgcatacatctgtaatccaaatgatagcaatttactgcgaaatgtttgacaaatattggcaggctgattatttaccaaagctattcctgcttttggataaaaaggggacaatttattgattaaattgggagataaagacttcattacactgctattattaaaatctgagaaaccacctgtttcttgcatcttaatctcatccaagattcttgttaagagtaaaaagaaattgtaatcaagctgccacaaaggggaaatgaatcgttctatatgtgctcactctgtaagttatgaattttgttaattcatgatagctaattacatacatacatgcaaaagtttcttagttataaaactctgtatgtaatttccaaaagccaccattgcctctattttcaatccattctcactaaatggtattataatagctagtacatgttaagtacacaggacatgccatgaaaaagcttgacagaaattaattgatttaatcctccaaacagctccatttaaagagtaatattattacctccacttttacaaaggataagactgaggtacagggtagttaagaaacttgtccaaggtcacacagaagtaattaccagaagggaggctgggactccaagctttcattctgaactttagcaaaatgggttaggctctcaacaaatatttaaaatgagctcaactactattttctaaatgtggaatgacaattatgaaattcattactttggaccccatttagacctcctctgtaaacataactcgtttttttaaaaaaattcatataactatattttcatccggttattgcctatacaatgacttctcaaagacatagcagaaaaaacagctgaattttataagaatgtttaagtttcacaaatgtgtaggaatagcagagggtcgatatttagacagccattctcactcctttttttcctaaatagttacttcttaagtagacgttggtctcttttaagctaacaactagaatgattcaagaaaaatgctagtgaagcactatcaggaatttcttaatgataccatatcatactaggaaggtaattcagaaatgagctgccttcattgtccatcatgccccacttaatccctaacatttttgacagaagtatttagccaatgtgaacacttcctcgtagtatggcccattccttctttgaacagttttaattattttaagatatctcttacatgaaaccaagtactgctttcttcaaaccccacatattcttctctttctttagtgtgtgtgggactggtgaccactaacccaaagaatccagcaaaggtgatgagatgtttcttctgtggctatgctatataggattgcaaaatctgtcttgctgggagacaggctcccttactggcattaaagaagcaagctgccatgttgtgagatgtcctgcagaggggacagcatggtggcctttagtcaatagcccacaagagactaaggtcctctgtccaacaggctgcaaggaactgaattttgtcaacaaacacatgagcttggaagcagatccttcccctttgaaatctaagactcccattttggctaacaatttcattgcagcctgtgaaagatcatgacatagaagatgcagttaagctgtccctggattcccgaacgacagaaactgtgagacaataaatgagtgctgtttttagtatctaaatttgtgatgattttgttaggcagcaatagataactaaaaactacgtatcacagtttgaatgctaattctccttaagaggcttcattaaaaataataaaattctattattagttgtatcacaacaacaatagaggcagccctttattgagtatctactatgtgccagacactctcacttcactagattctttccccctccttccacccccttttctttttttaaagtttcgggattcatgtgcaggatatgcaggtttgttatatgggtaaacttgtgccatggtggcttgctgcacctatcaacccatcaccgaggtgttaagcttggcatgcattagctagttttcctgatgctctcccccacccacccgcccccaacagaccccagagtgtgttgttcccctccctgtgtccgtgtgttctcatttttcagctcccacttataagtgagaacatggggtgtttggttttctgttcctgtgtttgtttgctgagtataatggcttccagctctatctatgtccctgcaaaggacaagatctcattcctttttatggctgcataatattccattgtgtatatgtaccacattttctttatccagtctatcactgatgggcatttcggttgattccatgtcattgctattgtgaatggtgctgcagtgaacatatgcttgcatgtatctttataacagaatgatttatattcctttggttgtatgcccagtaatgggattgctggattgaatggtatttctgtctttaggtttttgaggagtcaccacactgtcttccacaatggttgaactaattcacattctgacacaacagtgtaaaagtgttcctttttctctgcaacctcgccagcatctgttgttttctgactttttaataattgccattgtgactggcgacttcactagattctatacacaaatcatctcatttgttttcataagaaccttaaagaaaaggcattattagtatttctagtttaagaaactgatggtcagagaacacaagtaactcaaggtcatacgactagagtgtaaggaaactgcaattaaagccaagccttttcactgtgccttgctgctgcctaattcattggttgaaataaaccaaaacaaaaataaaaatttggatttaattttttaaaaaccaggactgggcccagtggcgtacatctgtaatcccagtgttttgggaggctgaggaaggtggatcgcctgagctcaggagggcgaagtgacagtgagccatgatggcaacaccaccctccagcctcagtgacagagtaagaccttttctctcaaaaacagcaacagcagttattaatatttaatgttattaaagtgtttctctttggcaaacatggttctaggcctcagacagccattggcatatcacagtcacgggatggcacatcatatatttggatttggatggtttacctctcattagtaccatcccacccctatgcctcaccacgtcttatctgcagtagactcaactttcccagtacttcaaccactttcaccatttcatgtagaatgttttcttttctactttttttttctttattgggggaggggatggggtttactttgtcacccagcttggagtgcagtggtgccatcactgctcactgcagccttaacctcccaggctcaagcaatcctcttgcctcagcctcagctgggtctacaggcatgcacctggctacttaaaaaaaaaaaaaggtaggctggtcttgaactactggcctcaagcatttctcccaccttggcctcccaaagtactgggattacaggcatgaaccaccacaatcagtctacgatgttttcttgaattgcttttgctttcattttggcttcttctcagtatttctgtaacttttactttttatatctctttaacaatgtggtatcttaaccaaaacataaaattgaaatactatatgcaaaactgataaaaataaaagaacttgataatattggctgggcatggtggctcacccctgtaatcccagctactcaggaggctgaggcaggagagtcacttgaacccgggaggcggagattgcagtgagccgagattgcgccaccgcactccagcctaggtgacagagtgagactccatctaaacaaaaaacaaaacagaacaaacaaacccccccccccaaaaaaaagaacttgtcaatatcacaatgaatattattttccttttagaaactgacatatctaattgacaatataactgagtgaggaaagtgaatatgaataataggattaatatgcttcatacaactaatatgtataacttaattgtttttaactctaaaaagcaataaataatatattctaaaacacattttaaactgacaaaaggtgatctttattaggacaaaaataaaaatctcaatatagtctccaaaagagaaatgatatagacttaaaattgaataaagtggtaataaagttagacaattaaaaactgaagaatcatcaaatatcatgccttgaaagattataataaacacacacttctaaataagtcttgaaaaaatgaaacacatttatatgtgtgtgtgtgtgtttatataaacgaagtttctaattatttggaaatgtaaagtattaagagcactacaacaccccttgtagaaagaagccaaggttgcatcaagaaaaacatttataatgttaagagcaaacacagataagagaaaaaatttaaaaataacataagtataaagtaactttagaaaggtaggagtgcaacaaaagaaaatgaaccgagtgggtgcattaataaaggtaaaagtgtagattaatcacactatataaaatggaatgcccccacaagaatatgagacaccatctgccatcgataaggacaaagtatgtcccttcagggtctaaatttgctggagcctttggtcacatttttgttagatcccaggatattgttgttctatatgttgtaaacagaaacaaccatagtgaatcttcaattggtatttttttttgtcgtattttaacaccaacatacggggaaagcttagaaacaagtgtcctgtctgttaatgaattttaaacctcagggatttcagttgttaaagaccttcctttattatcagccatgaaaattagtattcagaaagaattttgaaaaccaattattcttaagtttgataatcatgaattgggggatgaatttttaacaatcattgtcccaaagatattaccacaaatacattggtgctattaaatacttttatgtatctatttcccttctcaaaaggccttcctttaagccacttttcctacagagacatttcactttaacatgaaagtcatagtgtgtctcctctagaatattcgcagatgattgtcttcatttatcaggaacacatatttaaacagtttgcactatttcagttttccttgtgaagcagaagtattcatcataccagttgaggcttatattaccctgtagcaaagcgatttatcatatccctacatcagcaacttctttgattattaaaattctcttgcagaggtacacttagttgcacacaagctgctgtctaatgaattttctttattatttgacctgaagttcagggaatctgcatattaagacatattattcaaaagcagtgatagagcatgcagaaccagattaattaaactcatagctggaaatactttagcagaatttaatacttggcatatgtaagcgaacaaccctcaggaaataccagtgtgaatcattttttctcctttagaaacaatttttatttcctaaatttggtctgctataaaatggtaatttgtgaagctccagaattattggttcaattttgaatagtaattataactaagggtatgtgtaattgactcaagttactaatgaccacccttttcctaattattcaatattatttcagttaatatttattaagcattcttttgtcagcctgacactgtgctggtttctttcagagatgtcaaagaggtttacacatttcttctggcttcaaggagtttgtaatctaactggagagggaagactcatccattgaaactatatgggcatctaatttctcctccatgtgatatctctaatagccagccaggtttagatttattatccaaaaaacatgatttcaggtttccaaaggtagccaaaaggatcacacctcaatgttcaattcttttcaagcttctgcttgcatcatggtggctaacaacctattggacaagacaagtgacacagtcatgcccagatttgaggggtagagaaataaactgcacctcttgatgatggaatggcaaaaggtcctgcataaagagataatgtatccatctttgagagcctcccattacaattaaaccagaatttctggagtggaataaggacagagaattttttaaaaagcattttaggtgactccagtatgtaaccaatttgagggccagctgttttgaccagttcttctcaaactctggtgtgcatcagaatcacctggtaatcttgttaaactacagatttgtgaacccatccccagggacactgattcaacatctgtggagttagggactgacactttgcagcgctaacaagctcccaggtgatgctgatgctacaggtgctttatctacattttgattagcattaatttaaaccacggtgcaaagttaattatatgtatgatatgtaataagtttctattcatttggctgagttcctgtgaacagtttgtcaattttacaagttggaaaagttaaatctcccacatcatacacagggaccaatcttatcatatgaccaggaaaatggggagaagtccttcatcagcagttcaaagttaagtatttgagcatcataggacacttgatactgtccctgcattaatctcctgccttgtttcttgtaactcacttcctgggctcccgctatgcatcttttttcatcctactactgcactatggctgttttattcttggtacacccgatccatccctctgttcccaaatgggaattgagatcttgccttgttctccacactgatttaaagaactaagccttcccagcagctttctgccactagattttatacatccaacctgccaacttcatattgtatttgccttctggttttttctctttgtgctggttgttttcctttggctctccccagacccacactcctgccttgtctgctctattcctgcctcagaggttgatctcttatataatatattgcatcactggggatttcttgctgcctggtttcctgtacacaagtggttctcagagtaaagttcctggaccaccagcagcattaccatcacttggaaacttttttcattagaactgcaaattttgctggacatggtggcttatgcttgtaatcctagcactttgagaggctgaagcaggagaattgcttgaggccaggagttcaagaccagcctgggcaacatagcaagatccccatctctacaaaaaaaaaaaaaaaggaaaagaaaaaaaagaaaattaaatagaactaaaaattttggggcaccacgtcaaggctagtaaatcagaaactctgtaggtgaggcccagcaatctatatttcaaccagtctttctgaggactctgatgcatgctaaagtttgaaaaccactgacataggatatagctgatgccagtcactggcaggtctatgtacagacagagagagtagaaggtctgtttctccccttgattccttcctgctctgggctgcattttcttacagagtttgcatgcctccacaacttaaagctcttaccaggcagcctttcctccaaaattgcatttcactctggtctccaataatattatttcctcctctccatgcttcaagcttaagagttgtaacagcttcctgccattgctatggtctaggcctcaacatccgtttttgttttctttaacttacgtacatatcagtaaatattctcattcttaatgtctcctaaacttttgattacattctgtttcctgctggcaccctcaggtactgctgcccgtgaatttccttttcctagccttctttatcctgagtcctctcacccaagatctagctcagatcatgatgattaataaagttgggataaatgttacttacataaaggtgtggtttcttataaaggcaatcttgagagcatgaaagcattacagttcatgaagccaggaaaacagagcccttcctagagttcctaaaatctcattgcacaggcagcctgtcagtgagtacacacacatgctatgatacacatgtactgtgtgtgtgtgatgtatgtgttgtgtataagtgtgcataagggaaaaaatgagcatcaagattttccggcaaaataagtaacgaaaccctgttaatctcctggcagctgcttcagatgtcagaatacatttgtcaaaaaaacaatagaatctggtttgaacagctcttctgtttgggaaaaaaaagaaaaagtgaaacttagcaagaatgtgaactagatcataaacccaactgggtactaatgaagatggtatgcttccaatttcagtggtctttcctggtcaacgatgttgtgcttgtttttgttgttccttttgttttatttttattttttcttttctttttatttaaatgtatttatttacttattttgagacagggtctcactctgtcacctaggcaggagtgcagtggcttaattatggctcactgcagccttgacctcctgggctcaagcaatcctcccacctcagcctcccgagtagctgtgtctgagtagctgagactgtagttagctagcatgcccagctaatttttaattttttgtagagacaggttctcactatgttactcaggctggtcttgaactcctgagctcaagtgatcctcttgccttggcattccaaagtgctgggaaaataggcatgagccactgcatctggccttgtttcatttttaatcttttctgtgtgaaagccctcagtagtggtcagaggtaataaaaaatactcacacagcagataatttcccttgaggcaggccaccagtggcaaaaatgaacttggcaccacatgtaagaaatggtcttaaacacacccaatttaactgtgagcttgactttagcttaggattgaggtaagaaagagctgtagctacacaaagatggtcttctaaactttctacaatcatgccagttgtcgtggctcatgcctgtaatctcagcacgttgggaggccaaggcgggtagatcacttgaactcaggagtttgagaggaacctgggcaaagtggtaaaaccttgactctaccaaaaatacaaaaaattagcacagtggcatgtgcgtgtggttacaactactcaagaggctgagatgagaggatcgcttgagcctgggaagcagaggtggtagtgagctgagacggtgccactacactccagcctgggcgatagagcaagaccgcatctcaaaaaaaatcaataaaatttatataatcaaaactttttttttctgatacacagcaccaatgcttccaaggataaagaccttttctcctaagaatattaaacaaagttgttacgattatgattcccatttcataggtgggaaaaatttgaaggcagacaaggaaagctctagcagcaaacatctagcaggaaatgcagaggaaaggaaattactctcacagtatgtaagggaatcatcttttacagacttgcatatgctttttctgaacaatctgtgtgtttttgtttagttttttaattaaccagggtctttattttagcgttactctacacatgtttcttatgatgatgtatttttaaaatttattttaattgtggtaaaaatcacagaatataaaatgtatcatcttatctgtttttaagtaatgttaaacatattcacactgttgtgcacccaatttccagaactattccaattttcagaaaactgagatcccatatgtgtccccaccatatgtttttaaagcacatatcaaatatcttcttttaaaaaattcatattttatgttcttgaatgtttaactttatcatgtattataaataacctaccagaattaatgcggattttaaataaatatttctctctactaagatgctttttttaaataagtattctttgaactttaactctgtgggactccatgtctacaatggtgagaaaagcagacatatttttcaaatggtggggcaaaatgtgtcatgcagtgaggctaacaacattgaaaataatgatgatgatcacactgactggcacaacactataaataataatcaggacgagcaatgctttagatcccagggttctcaaggggtattatgaaatggtgcctcttaagtccacccctcaaatttataattgaacatatcaaggacagactttgtccgttcattttaatagtatactcacctgctctagagacctggtccctcataacctagccccgatcctcagaatattagggttgccttcagcagatccactttgcaaagctatggagctgaacttctgtctgggaccgggggagtcgaattgtaggagacgttaacttcacacaggcatctaatggagcccaagaatatcaacacaattctcaaatgactctccccatttgctactaaagacctgcagtgcttctcatatcaccatggataatcattacttgcttccccagcccacatatcagccacttattattatttttttaaagacaaaacaacaacaacaaaacctgacctttgagatgtttaagagcgtagatactagagtgagacttccaggtttccattttgactctcatacttgtgtgatcttgtgcaagttatttaatctcagtatcccaatctagactactaattaagctagttcttatatataaagattgtggaataatttctgggtcactgtgtaggtcttgtaaacactacataagtattttctactagaggctcagggatttggtgaaccccataccaagttatagtcagtgccctgctgtaattcgtcatattccttaattctagtttatgcccagctgcactctctcctcatgcctaaatttacaaagctttttattccacctgcacaaaattgcagtgagtagacagaaaaactcttagcaagtgaaaatattcttgagatcaaggagttctaagcagaggggcagatgcatttcaaaatcagaacactgttcataggaagggaattggagggacaacctggttaccaagatcaagatagtaaaggattactttgcatctattctttttctggttactggatcacagatacccagaaagaaagcctttgcactttgacgttttgatctctttctgtagctatatccactacatgccaactgttaccagacactttcttctgcatatcattcatgatccttatctacagtaaataatcttcaagatttctcccaatatttctctaattttagtaactctttatatagcgaaaggctgtcacagcacccatgacttccatatgtccatattaatagcattttagtcttcagatatgaatttaaaagtcacatcctctagaaagcttttgctaacccccccagccttggttaggtctggttactatacattcttaccacttgcatcctatacctctttttttattacactgaacactcttgtatgattcattgtatttcttttccattagactctaagctccatgagggtgtcatgattctgtcttactgatttcttcttgtgcctaggacagttctaactccagtcttatttccaagcacttaaagtataccctgattctcttacaatgtcagaattttcatatttcttcctattattttttcttttgtgttttattactacttaatgttcctgactctagagttgttatgtaagccagtctagactgtggttaatgttatgaggaaacacaacatgaattcaggaagttcttatagaatgttacctgcgaaagctccagtggctttggtgattaaactgtaatctcagttaaacatcttactttccattgtgggaaacttgctttggcaagattcaaacagaatgaacataaattctaataaaatatgttaatgggacttcatgggactcattagtccagctcccttgcctcacttaaatctacagtacctgttaattcctaccagcttctcttatagttttaaaggtatccatggactcttatcttaaactatatagatttgttatgcaccacccccaaaattctccaaggtttatgctcttgatttaaatagaagatttttacaaggcaataatttctacaaagatgtaattttataaatgctttatccccatcttttaagagctttccataaaattaaaaataagaaaatgattattgttgttatccttggtgaataaaccatgtaactgttctctttaactttttaaaaataaaagcactgacaataaagttaacaatgggcatttactaagcactaagatacatatgagctttatatttttaacatataaatttcacaataattgtgcgaagtatttgctattattcctatttataaattaagaaattggtctgcataaaagaaaaactcatccaatatgaattaattggtaaatgaataaatttgaattcaaaaccaggtctttctgcatccagggcccgtgtaccttcagtaagtactacctcaagtgtataaaaattatttaaagttaaaaaaagaaaacctttgctttactcccttgtaaaaactcatgaattacacaaacgcaggaacttgatgttagctgagcatgcacacactctgagcaaagaaatagggttcacgatcaagctgtggtttctatggtgtcttttcacagaatggaagagacaaccacagagtttttatgctgtctttatgtagggcctgatatagtcccatcatttaatttttttccattactattctgaacttagaaggctgagaacataaacaaatacagctgttttaaaaaggcaacaggctttttctccctccatctccccacccctgcttcaagatttgaaatgttaaattaataataggtgaagaaaattaaaactcttaattatagtaaggtaaggcaacaaccaagaaaaataaatgcatgggctatcccggtgaagaagttaaccattttgctaaatgcgaaataaaactataatgaaataaagaaatgttgagtaacaaaacacttaatataatagttaatgttagaagtcataatggttaggaatttattgaactgcaagaagcaggaaagccaatcacagaatagcttaaaacagttgttctgaagatggctgatgttagaattacccagagaacacttaaagttaccaattccctggccccagcccttctctctttctgatgaaattgatctttttgagagccccatataagtatcttttgtcagttgatgtattagttatctattgctgcataacaaattactccaaaacataggaatttagaacaacaacatttattaccttacacaatttgtaggtcaggaatctaggtgcagcctaactggccccctctgggttaggctctctcacaagacactaatcaaggtaacagccggggctgacatcctctctaggttgaactgggggagaatctgcttctaagttcattcctatgattgttgggtagcctcaatccctgtgggctgttggccaaagacaccagtgttttgtgccatataaatctctccatatccagaaagcaggtcacaacatgacaactggtctcccttaaaataaatgaacaagagagggctcccgaaatggaagacatcatcatttgtaatctaaatcttggaaatgacatcccattactttagaaatgttctattcagtagaagtaagtcaccagatctaacctactctcaagggaaggagattacaaaatgatctgaataccaagaagtgaggaaccttgaggaacatcttagagattgcttgccacagccaggaatgtgaattggcttaaatgaagagaggtttatttttctcacgtaacaaaaagcctaaaagaggtatagtagctgaacattttctggactgccagtcactgttggcatttgataggaaggagagggaatatgggagaaagagaaggtctatgcctcttctttttattaggaaagcaaatatatttttctaagtccctctggaagacttttgtttatgtgacatgggtcataactggatcacttgggatccctcaactaaaaatggaggtggatggtgagtgtttatctccaaccttagattaggagcagcaaggaagcctgagattgagaatgacttgagaatagtgcccatcaatgacctgtgcacaccatgcctccatttccttgtatcttactctttactgtatctcaatttaagtttgcaaattgaagcataaatcgatgccagtttactaaatttaatatacagctaatttcaagatcatatttctcatggcttcaactttatcacagcacgctcatgaaccagaaagtagcaaacacctttgagcagcagaaaaagttgtaatcaagtccatgtagttaaatttacagaaaatttctcagatcttaatcttcagttttatttattcccttttagttcacaatccagacaggattgatgattaattcatctcactgcttgtacatttgtctcagtttttccctaaaagggtatggtcaacattttagcatttcataaaagggctgtcataatctggccacaacttgcccccgacgtcttcttctatgctcgctccttccagtaactcaagatttctgaacacacatcctcttctctacctccctgcttcctctctgccttcaatgtccttcccgactcatctttcaaggtctacctcgtatcatacaatcttagatgtctatagggaccagggaaataatgtaaatgagaggaatgtgctggcgattgcatattaaacacatggaaatcatacttgcaacaagggatatatgctccatcctgcttttcttaatattttctctgttcttggtcattcctttgtcttctcattccgatagagacataatgatccactttctaaattctaaattctgatagagacaaaattatttcacttttgtgttaagaaagtgaaaatgatttacatccatttttaatcatgaccatatagaaaatggctacaataccatcatatctcctcctccctcctccatcttcttctccttctccttcttcttcctcccagggtgttgctctgttgccgaggctggagtgcaatggtatgatcataactcactgcagcttcacctcctgggctcaagagatccttctgcctcagcctcctgagtagctgagactgtaggcatgcaccaccacaactggataattttgtttattttttatagagaagggatcttactatgttgccggggctggtctcaaactcctggactcaagcaagcctcctgcctctgcctgccagagtgctgagattataggcatgagccaacttacctggcaaccatcatatcttttatctctctctttaaaaaatgtctagcagtaattagaaatccagattttaatgtaaagtgtccaattttaaaatcatggtgtttgtatatacaaatttactttttaaattattttcatggaggaagggaacattctgcatgtcacattaaatacatctggagtctggagcatgcctgctgactgcgagctagatcaaaatagttccctctttggagtcttttctaaaagcccaggttggttagttacttcctccactgttttccaggaatagcaaagatgacctccaagaggaacattttgtataccaatttacacatgtggtttacatgtgagtccttacctggactgagatacttgagaacagagtttgcagattatgactgtgttctcagtttaacacatcgagtctaccccatagttcccaccctgtaaatgcttgttgcattaatgcatctcagatgaacacgtgaatctcataaagaaatgtagctgatgtggagtggacatgatctaattagagaacaagaaagctttgacttagcagcaaaatatgtgaagaagaaatgtcctggtttgtcctcttggacaggattattggatagaggcccaaatttattcatttaacgagtgtgtgtgctggaggcccaagatgaatcaagcagttctagacactgaggattcagaaaacaagaaaacagagaaaaaaaaaacttgatgggaggggacaaataagaaataaaagcaacaaataaagcaaatcatattttcaattattctgatgtttgttttggagaaacagtgaaaaaaaggacagagaagaagttgtcaagaacctgaggaatggaggcatgtgcaagtttaaataagctagccatgttaagtgtctgtgagcaggagggcatttgagtaaaactctgaaagaatgaaagagccagccagactgataactggaggaaagtgctccagtcaggtggaacagcaagttgaaatcctgaggcacaaggatgcctattcaaggaatagcaaggcggctgggatggctagaaagaagagaatgagagagacagatggagagggcatgaggttagagacatcctagcaggattggagggagagagtgcaaccatctcttagggcccattttgtgacaactttaacttttattccaacttagatggaagccattggaagagcaggagagtgacatgatctaacaaattttaaagggattgccttggtgactctattgacgctagactgaatggagactagagtgggacaggatgaccacctagacagtgatagaaataacgcaagcaagtacaatgacagcttggaccagggtcatgatcacagagacaaagaggctgatagagaactgggattccaacctcattaggttcctaaaataagttaaaatcttccttgcaaagcaataggatcacaacctgacctgtcagctcagtataagaatatcttctttgtgatctttctagttttaatactgccaacatgataattaattgcctaatcacctgctgttttcttgtcaaggggatttttctgatttttctcctataatatattgtctgctttgaagccagggtgatcttttcataatgcaaatctgataatgtgtcccctttttaaagcagtttaatatcttctcatttcatggagggtaaagcaaaattccatatcatgacccacaggacacttttggatctggattctcactgtgatgccaaaatcttcacaatctgtgctccagcaaatctgcctgttcagttccttttatgcaccagcgttctctcacaccaggggtttacctatcctattccttctgcctgagtttctttttgctgccttcttcacctcgttaatttcttctcatccttttcatgttagctcagtgctctaagtgctactctctctgggactctttctctaagatttctgactattgggtactcccctattgtaggctctagccatacctgcacctctccctgcatatgtcacagttacagttttttaatacacttgggtgatgactgaactgatgctacctcttcctgtcaccagctccgcccccccacccaaactagactgtaaaattcttggaagtaagagccatgccttcttttcttcatcatttattcccagcatgtagcaccatatctagcacatatatgttggatggatggacggatggattcatggatgcatggatggatggatggatggatgcatactacgactggcttaaaattttagcattattcatcctactatttctcacaatttagtgtaatttgtattctcagaagcatgaatagaaaacaattgcaagtgttggttgtcccaaatgtgctgctgtaaagctgggctacaaaggcagtcattttgccctgtctggggataaataggcatagtttgagtaatggcaattagagccagaattcaactggtgaatcacattgaccaccacttgagtaaacccatggactgtaattatgtctagtccttatttggaagcctggggaataatgcttttgtttgcagtgtttctccctggcacagtctgtgagcccagaatgaaaagattattatctttaaccagaatctcatgttctttgattttcatcaagcttttcacattttcatgttaagaaagtgaaaaggatttacatccaagattgattcaatgacatttttgtaactgattgccttttaaaaaattatattccagagcttcaagtaaaagcagtcttgcaataatttcataaggcaagaatgcattacttctttacttctaaaaacaaattgatgctattgtacatattttaactaaaataattttatacacactaagatcaaagatgttatctaaaagggctaaaacgagattccaccatagaccttacaacttaaaaaaatcctgtcaatatttgattacccaactgaagaatgatgtcttattttttagcattcctcataaatcctatttcttaattttcctataaacaggctggtgtgttttgctatcaagcaatttaagtgtacatttttatgggatttggggtcattgttgaaaccacgctaataaactgcaaaggcagttgatgcagataaaccttagaacaataaatataagaacaaagggagaagaaaataatgtgcatctgctgaaggggaagataccgccgaatactaatgaggaaagtggtctgggagttgatgtagaaaacctctaaagcatgcagcttaatgtgcaactgcggcaaaagggcatggagaatgctagattgtatggctggggaaagacaatataaatcagatttggcatcgttaatccaagctccagtattaatgtcacctaaagaattgttctctatgttgctcttggtcaagagaggtgcaaagaatgcatttaatgttgaaattgtgtagtaaaggggcagctccaggaatgtagtggtctgaggttagcaactagaggaaaaagaagactcacaacctggctagtagctgtggactaagatgagcattgctgccctttctttttatatgggccattgagagttaagtaagccagagatatcatcgagttaatataaaactggaccctaggccacttgggctgggctcaatgaagacttccactttctagaaaactctgagatttctgccctgtcagcgtgcccaacctttcctcagaggatactttgctgtcttttctcacaagtatttcttactttttaatctgcgtaaaatctataaggtacacttagacctgtgtatatgcatttgctgaagtgttcccaccactacgaccactaaaatacagtcctttcttaccttttttacctttttttttttgagacggagtcttgctctgtcgcccagattgcagactaatgcagtggcacaacctcagctgatggcacactccacctctgaggttcaagcaattctcctgcctcagtctcccaagtagctgcaactacaggcatgcatcaccatgcccagataatttttgtatttttagtagagatggggttttaccacgttggccaggctggcctcgaactgctgacctgaagtgatccactcgcttcggcctcccaaagtgctaggattacaggtgtgagctaccgtgtccagcccctaccttaattctattcatcctgaattcaacgtaatttggaattgaaaaactgtgagtaaaactgcaagaaactccaggaagttgtatgcattcatccacatgagtctactgtctacacacttatacacagacacagagacacacacacatgcttatatatacacacaaacatatagtctgtttctggatgtgtatatataaatatatatgagtgtgtgtcatatatatttactccaaaacaagtctccttcaccattttgtagataaaaacttcaaatgagtgtaaattcaaaagtaaatacaaatttaaggcaatttttaagtctaattttccctacttgcagggccagtttttgcaatataaaaaaattggatttatttagcttgatttgtttttgacaaatcagaattggctgtttataataccttgatatccactctgtacttggaaatcgattttttgaccaattggtatgaggtgtctctgaatctttctgggaatgttactctctcacctttgcaaatctgagttgacggtgctgcagtgtgctccagagaagcacactgcaggtggtgagaagtaaaagattcagccattggactggttgtcttgtctatacagagccagaaccatcaacaggtaaccataaatctctcctggggaatttcagcacataaacttttcctagagtctccagactgtgtttatactttgtagatattatgcaaaacatcacagcactggatgtagtagtacaggatgcatttgagagcggtgtgcacaacatatacagttgacccttgaagaacgttagggttaagggtgctgacccttccatgcaataaaaaatgagcatataacttctgactctccaaaacttaactacttatataacttactgttgaccaaaagctttgccaattacataaacagttgattaacacatattttgtatgtcttatgtattatgtgctgcattcttacagtaagtaagctagagaaaagaaatattattaagaaaattataagaaagacaaaatatagttgctattcattaagtggtgtgggatccttataaagtctttttttttctttttttttaaacaaagtctcgcactgtcacccaggctggagtgcagcgcagtggtatagtggtgtgatctcggatcactgcaaactccatctcccaggttcaagccattctggtacctcagcctcccaggtagctgggattataggtgtgtgccaccattcccagctaatttttgtatttgtagcagggatggggttttaccaagctggccaggctggtctcgaactcctggcctcaagtcatccactcacctcagcctcccaatgtgctgggattacaggcatgagccacctcacccagctcattataaagtcatcatcctcatcatcttcactttaagtacgctgaagaaaaggagaaagaggaggggttggtcttggtgtcgcagaggtggcagagacctaaggatatttgtatataagtgaatctgcacagttgaaaccagtgttgcacaagagtcaactgtatagatacgtttaaaatagtctttagaattttgatatcatgaaagtcattattgatttcttatgcaaagacagagataattttaccccacctggaagcaaattttaaaagttcaatttttacatttataaaatccttaagtgtcataaggtatactctgggacactgtgttaatatagcagtttattcagttttaaaaatctgaaccagaactttttcataaagttcactgcatataggactttcttttcatgctcttacttgccaagtgaatgaccttgaattgtgcccagctccagccttgcgaagcaaaggtactaacagatatcaaacgaacactgaggtgataaactataagatcctatttgaaaattcaaagggtggttcttaccatttttctctgacattagaggaggcatgtcacaatctgaaagtagacctttggtctttaaacagtagctatgaaataagatagaacatattcctaccaacttagcaaaatgtatttttattttgatatatgacagcactttcccgggtcgtatttcacactgggctgcaggaatattgcctggattgtattaatgtgatcattaatttgatttaaaactaattctgttcttttaagcttataatttaaatttaaggtaaaataccaaagaaatttcttttccttatagatataacttcaaatgtgtctgtgcattttgtagaattggagttacaaattacagatttgcagaacattattaaagaaccatttaaatgtataagatattaaaaatcccattagttcagggtatatattttcctgactaaattaaataaattctatccaaatcctattttattcagcaagtagagccatcaagagagagcactatggagtctgatgacctggattgaacccaggtgtggtaattgcatatctgtgtttccttgagtgaaccacttattcattcccagcctcagtttcttcttctgaaaagtgtgaaaaatctaagcatttaccccactggttaactgtgtgctgcacataataggttctccataaaaggtagctacaattatcacatttttttctattgcatgcaaccctatcttctgttaatctgcatttaccatttgtttctgcctattttcttacaattctgcattttatacttctttctgtgtactcgttaggatcctccaacctacagtacaaactgtattactaattggcactatataatttactatattactaatatttaactagtactatttaatttaataattactaatcccttcctcacaacgcttaagtcacgatagtcaataattatttattgaacccaagcttagctattgaaatgtgtaggtagattgtgaccagattcaaatgttaacctataaagaactggtagttttaggatattttcctccctttttgaagaacattgcacactttccctggctgtaagggtagaatgtgaactaggctgggctaattgtatataaaatctgccttaagtgtagatagtgtcagcaataagaatttgaaccacaatcagatcaatcagggatttcccaaattttctaatggacttagcaaaaagcctaatggacttactctcatctttaaaatatgaacaataatacatccacttcataaaattgctttgattagtaaaagagtattaaagaacttggaaatgtcctggcatgaagtaatttcttatagctgaatacctgctgttattttattggtattactattggtatcatcttttttcatgggttgctaagatgggagaatatgggtctgtagctgaatatgggtctctcgtcttctcacctattgcatggggaatgtctgaacaaacaatgatagcaagcaaaaaaatatatatatatttaaatatatatataaaattaggaatgaagaaagagactgtagccaacagatactgctggtgcctgtggatccaaccatgcccaaaggccagaacatactattggaatctccaaatatatgatacaataaatttccattaaaatagtgtgagccgaattttttgttatttgcaatacaaatagtatgattgaataatctttccactataccatgtagccatcaaatgaggaattccctggtaaaattaattaatttgaatgacaaatttgatcttcaagactgaatttttctgcatgtacatgtgtggtatttcttttgggagaattatccaaataattttttttttttttttgagatggagtctcgttctgtcgcccaggctggagggcagtggcccgatctcggctcactgcaagctccgcctcctgggttcaagtgattctcctgcctcagcctcctgagtagctgggactacaggggtgtgccaccacatctggctatttttttgtatttttggtagagatggggtttctttctttctttctttctttctttctttctttctttctttctttctttctttctttctttctttcttttttttttttgagactgattctcgctcttgttgcccaggctggagtgcaatggcacgatctcggctcactgcaacctctgcctactgggtccaagcaattctcctgcctcagtctcccaagtagctgggattacaggtgcccaccaccacacccagctaatttttgtattgttagtagagacagggtttcaccatactggccaggctggtcttaaacacctgaccttgtgatctgcctgcttcagcctcccaaagttctgggattacaggcgtgagccaccccgcctggccgatcatttcttaattaaatgcttgaccctgtctgcatagccataatgaattaagaatggaaatgatgctgaaatagaagaaaatttggaatcattactattgttccacctaattaggacactcataacgaccaatgaagaatctgcagtgatttcattagaatgatttgatattctagatgtccacactcagtgtaaacaaaggaaacaggagcttctttgcaaaaacacgcataggggagtaagaaagatacataattgcaagtcttaatatctctggtctaaggatgaggacgtaagagagctttgggtgtaaaattatgatttttgtcttctgcatattgcatagcttggaatattaaacagttgaaaataaactttcattttacctttagttatttgagaattttagaataaagtaagtatgttgagaagcttcctatgtgaacaattttcttaataatttcttcataaagtttgctatattttagcttgaatttatgttcatgagaggtataaaaaatatttactataagtaatttatatgtcaacaatacaccttgtttcacttagcattcatacatgttatgaatctttcgttcaaacttaattttaccaggtaaatatataagagatctttaaatagtaatatttatattccatatctttattcaagaataatattttgctcaacatacatatttgtgtaatgccaaaaatttattctccaaacatctctcataataatgcttaatatgtaatacaatgtaatactcaatataagacagtctctaataatcaatacttaatataatccacaacaataataatctgttggtgcctgtactataaaaaggtaatacttagaaaaggtcagttagctaaattttctccaaaattacaaagtatttgaaaattaattattacaatattacatgtcataaagtaagtaaatagctattttttctagtgatttttattttattaaataagtgtgtatatacatataactgtgtatattatatatatacatatatacactttatatacctatacttattggatttatatacctatatacttacagatatataaagtatatacttatgtgtatatatgtatatatttatatgtatgtacttatgtgtatatctgtatatatttatatgtatatacttatatacttatttatatttataaataagtgtgtgtatatatatatataccttataagtgtgtgtgtgtatatatacatacacctctatatatacatacacctctatatatagagagagaaaggtgtatatatacttattaggtatatgtatatactacttttgtgggtatatctatacctacaaaaataaatgcagaaatatgcctctgactagaatagcttgagaggtgttgtgaaatatcaccttgaactaattctttcacatgaaaataagcatgaagtatgtttccatttatttgttaagaaatagtctgaatttagcttgtggatcctaggttaatacatttcctaaaacatttaagagcttgtatttttcacttcttttggcactgattctcctctgtcttcattttacgttattctttcccatttatgcttttttcctgaggttggttctctatttctctctccctatatcattttctcttaagacagttggtggcatgtgaagatgggatttaactattagcacaatcttgcctttccatggcagcctttcccctaaggaactggctttcctttgaaattggctttagatctgacagggcttctgcagtttcacattactgctagtccaatagagaaaatgaaaccaagaaatttgatcaggttaccctagggcaaaataaaaggttggtttggggaaatgcttaatttccatgatccagcagggatttaccagcctgattctcctgagaaaatcagaatctggttttccatttatccatccagcttttccaaattaccatctctaggtggtttcaaagataagaaactggaatggattctaaatgttgaattcaatttctgatatggagttatcttaaaacatgggtcagaacagcaagcccctctcccctctcccttaccccaactactaccaccaaataatctatgtcttttagaggtctttagtagatttactcaagaaaaagattcaaggaaactgaaataaatgcttcagagtcagggaccatgttagccaaaggttaagaatcagagactaggttaattgaggaacgactttcaagatcttatattctttttatctttcttgcttcatagaggggaatgttgggcaatgggctgtttcattaagcaataaggagaaaataatctgacacccattccttgcatcattaaacatcagatgaactaatatgcatagactcttgctattactgcacaaagcctttgaaaatggtcaacatccactgccatgctttctctgctgtatttttaaatattctatatctgatgagtaataaattcgagactagtttaattttataaaggaactagatgtgtccattctccatcatttgtacaaccttgtaatatacacatgtggaaaattgggggcaacattgcttcctttctttgcacggaacacggaacaatttaaatttgtcactctcatttacttattgcagagaaaaataaggagcatgtcttttgaggcttagctttgcatttcagactatacaggcaaatgtgggggtgtcacaacaaatgcaggtgaagagggggtactaattaagaaccatcattcaatatcatttctacattagattaagaaaaatacattagaatgctccatcttatttttctcaagaggtcagaatccaagctactaaactcattagaacaaacataatcactttttattcatttcaccacagttcaatctaaaattaggtctcatttgacttttaccaacatgccttctaaatgcatcataagcatttcttcattttgaagaagttaatacaataggccacatacatctttgcccatattcatttttttgtcaaatcaagacagttccttagaagtgtaaagattttttctttggttctagggaataatttttcttctatagacttcccagaatacacctggggaaaagaagttttgattcacaaagtgagtcttgagctcttgctaagatactgagaacaccacagaaagggtgaaattcaaactgtatgtatgcaagtatagttctggtattttaactaaatcaatttggacaaccccttagacattttttgttacttcactgatgacaaaataagtctttcatcacagtcagcctcttatgtgtatgactgctgcctcatgtgtaatttacttctaaagattgaaaatatcttaattaatgacccaaacttaataataatattgacttaaaaacaatgctgtttctgcacaagtgaggtgaagttcagagtacaaataacagaatagttaggaaagaaaaactgcttgtatattttgtactaagattgattggctctaagttatttgggtgactacctcagttatccactttacttggaacagatatggtttaagtcatggcaataaaataaatgtcataactttaaaaataaataaacacaattaaccgatgttgcagatatttcattcatacaatatttagtttccaatttgttcatatagatatataaaaacaagaaactacagtagtttatataaagaataactttaaaaaatccgctcacatgtaaaaagaaaaaaagcatatcatatttgaaatcatgtaattctaactccctacataagaagagagaaattagcatgagtgaaagcacaacacgaatttaaatgttgagtactagttcgtttcccttctattttaaataaatggacattcattataacatatgataacatggcggtccgcttgcttaaagtcgatgataaccgtcattttccatttgatttgtgcatacgttttgagtagtacaattgtcccttggtatccatggaggattggctcagagatctcttgtggataccaaaatctgcagatactcaagttcctgacgtaaaatgctgtagtatgtatgtgcatataacctgtgcacatcctctcataatgtaaatcatctctagattacttatagtacctgacacaatgtaaatgctatttaaggccgggcgcggtggctcacgcctgtaatcccagcattttgggaggccgaggcaggaggatcacgaggtcaagagatcaagaccattgtggccaacatggtgaaaccccgtctctaataaaaatacaaaaattagctgggcatggtggcacacagctgtactcccagctactcgggaggctgaggtgggagaatcacttgaacccaggaggtggaggttgcagtgagccgagatcgcgccactgcactccagcttagcgacagagcgagactccgtctcaaacaaaaaaagaaaaaaaaaattgtttctgtatagacatattttttccaatattttctatttgtagttgattgaacccatggaagctgaactcaccaatagagagggtcagttgtatacaaatatgcagaacacactaagtattagacaccatatatgttacaaaggtgaccgagacctgattctcctcaagtggagatgagccaccagctacaatatggcagagactaaaatgatcattttagtctccatcatacaccatttattggcagcttacggagttggtgttcccttgttttgcaacgtagttttctttatatccttggaagttcataagtgagagattcacaactagaaaaggtttctgtatgaatatgcagaggtaataaactgtgtcttttaaagtacctgaatcagagcagacagactaagattcaagtaagttttcagctatgtgactttcagtaaaacactcgaactctctaagattcatttggtacgtctgcaaaatgagaaaaataagcgtagatatcatggatgcatgtgaggattaaatgaggtaatatgtcaagcatttagcacagcacctaatacaataatcattacaataataataacacaaaataaactactattagtattaatgaaactcaagttgccatgtaagttccaaggaaaatttctgtggaatgcatttggggatcagaagcattctagtagagaattaaaggatttgttgatttaaaacagaccaagaagacaacacaagtgtttcaggagaaaggagtggaaaaattaaatgctgagtgttaacaaaacaaggcgtgatcttgagagaataaatgtacagtcaagcattgcttaatgacaagatacactctgagaaatgcctccttaagcagtttcattcttgtgcaacatctccgaatgtgcttacactgtcttggatggcatagcctaccacacacctaggctatatggtacagcctattgctcctaggttacaaactgtacaacatgttactacactgactactgcaggcaactgtaaacccatggtatgcatctgtgtttctaagcatatttaaacacagagacggtacagtaaaaatacagtattatactcttatgataccaccgtcatatatgcagtctacataccgaaacgtggtgttggtgggacatgatgacagtcaaatttgaatgaaagcaaatattaggatgtgagactagaagcacaatttgaaacataaacttctcggttcttaaatgacaggcctaaaagtctttattggtctttatttcatagagcaattgaaatctttgctaatttttgaagttagtaagatgtattgaatatataggaaagtagatatgagaagaaaatttagaagactgttactaaagtcgagacaaaggccatgagctagggggcactagaaataggaatgaaggaagagaaatgagagataattataggataaacttaaccagacctaacaaataaatatataaggccatgcaaaggaaatcatccagggtcaaatgctggatgattcttgatgcctgtcatggggctgaattgtgttcccccaaaatttatatgtaaagtttgacgctagccctaaccccagaacctcagaatgtgactgtctttgcagataggatcattaaagaggtgactgagttaaaataagctcattacagtgggtgctaattcgatataactggtatctttatgagagaaggaggttagaacatggacaggcacagagggaagatcatgtaaagacacagagagaagataaccacctacaagtaaaggtgagaggtgtccaaagaaaccaaccttgacaacatttgatcttggaacgccagcctccaaactgtgagaaaacaaatttcttttgtttaagccacccagtctggtattttgttatggcagccctaagaaatcaatagagtgttattcacagaaacggagaaaataaaagtggagcatatttagatagacacaggtaattagtataatcacaggcaggttgacatgactcaggctttataaattaagataataatggtttcctaatgatctggtgcttatgttgaaaacattaaaagtataatgctataattttattttggggagaacacacaccttgtatattatattcatcagataattaatgttagctaccataaaaagaaattctgcccctctctcaatctcaatggcttcacgaaataaaaacttattttttgtttatatgaattcactataaacatccaagttggttcctccttttttaagagttaactcgaagagctttctctctttttttcttgtagtgctttttcctttgcttctagccacatggatggaaagagaggtaacttgaagaatggttttaaggctatgcttggaagtgacacatatttcttcctcccatattctattggctggaactcagtcacataattctacccagatgcaaggcatcctgggaagtctagtttagctgtgtccccgggaataagaagataatagaatattaatttacacatgtaaactttgccttttgggctaccagacttttagtgtgcagaattatacataatggggaaagggaaaagagtagctaattcgatatagggtatatttctatgaaggtaattcagaagaccatctggatttagaaatttcttctcaacaatataaagatgcttagcaatccctaaggtccagaacaggctttgagaaactttttctgtaaaggagtagaaaataaatattttgagcttttgatgccacatggtctctgtggaaaccactgaactcttgttactgcagcacaaaagcatctaaagacaatatgtaaataaatgagcatggccttccaataaaactttatttacaaaattaaaaaaaaaggcaaaccagatttggcttacaggccatggtgtgccaacccttttcacagcatattaggtaatttgtcattttgcaagtatttcatgcttgtgctcaggtaattgtgcatgggcagcgagcctagctaactgccagcaccatcaacagtggctttgcccattatcctcagcaaactaaagcaggaacagaaaaccaaacactgcatgttctcacttacaagtgggagctgaacaatgagaacacatgaacacagggaggggaacaaaacacactggggcctgtcaggggagggtggcattgtgggggagtggggagcatcgggaaaagtagctaatgcatgccgggcttaatacctaggtgatgggttgataggtacagcaaatcaccatgacacatgcttacctatgtaacagaactgcacatccttggccaggtgtggtggctcattacacacctgtaatgccagcactttgggaggccaaggtaggcagaggtcaggagtttgagacacatctgtccaacatggcaaaaccctgtctctactaaaaatacaaaaattagcttggcatggggccacatgcctgtaatcccaggtactcgggaggctgaggcaggagaatcacttgaaccctggaagaggaagttgcagtgagcaaaaatcacaccactacactgcactctagcctgggcgacagagtgagactccatctcaaacaaacaaacaaacaaaaacctgcacattttgcacatgtatcatgggacttaaaaaaaaagaaaaagtggcattgctctttgccatgctctaatttacttggtcaaagtacatggagtatcatttgccaagagaaaaaaaaacaaaaacaaaaacaaaaaataccctaagttactttgtaaaaactgaccttaaaatcaaagataactacttcagttgattatgaaagtaaagaagaagtgaggagcccaagaaaatggtagaatatagctaggagatgtcacagttaatttcttttattttgatttgtctcagaagaagggtgttttttcttgcctgtaaagataacttttcttgatttcatgatttcttaaatccagaggaatcttttaatcaacctaatttttagctgtcacctccattctgtccttctacactggccaatctcttttacattgtagtacattgtaggtgtcttctcatgatatttctgtctctagtttttccgatctgccaaactgcacaacaaagcacgtgtgaatcagacagataggagtttgagttctccagtctttcactctttaaccttgtgactcagaaacttcactttacatccctcaatcctcaagtgttcattcctaaaagttggcaaaggcacaatattaaactcaaagatttgtttggttttgtctagattaaatgagttaacctatatacagaccactaaactcagtgtttggaacctagttaagagcttgatattagtttattagtattttaatttttcagtaattctatcctcaatgcaatatgattactagaacccaagttgtaccaacatttctctcactaatgtcaccaatggctttgtggggtgggggggctataaaggtttttattcatttaatattgttaaacatcacttcctcagcatacttctttgctatactgttcacgtcactgtactctgctgtttatctcctacctttatgacacttctttcttcatataatttgatggtttcctttctctgactcctaaatgaaatgcacagagcttatttctgtacaaccttgctccccacactcactctcattagaactctttctttgcagggaatctcaacaacccctgagaacaagtcaaacacattccttacgttctgttttaagctctcacatttgcgactctttatctgctatttccatgggtgtatatctcacccatgacaaagtatactccaaaccaaactgatgacgtttgaaacgtgaatagtcttgctaagttaccatcattgttcccatttcccaggcttgaaacttttgtcattttctaccctcctgcatcttcttctcttgtatttattcagttctcaaatcctgcccttccgtcaaaatatctgcccttccctcatctccttgataaggtccttagatctcatgcctgaattaatttctgccctaaaagtctatttttccttccacccacctacctattcatccattcattcaatgagtattaatgctctaccatgggccaagcatcctgaggtctctactatgaaaaatacgtgaaatatcaatccactcctagcttttcagggtatatattctcttggacgacagtggacattgataatgcacacatgctatggaatcaaatagtcttctgttaaagtcttggatcctttatttcctacaaccttagacgattgacttaacctccccatgactcattttctcatgtgtaaaatttggatagtaatggtacatccttgatagatattttgtgactatgaattaggtggtggcacatctaagccttcacactgtgtcaaatatctaataaaccctcaataaatattaaccattataattattaccaataaaagcagaaaggaacattgtcatgacaaggctatgtgtgattaaaagccaacatgagaattatctagagtagcagtgattcaaggaaactgaggtgagctgtgacccttctggggccagttcaatgaacaacccaacacaaagacaggtttcatttatgagtggtgctgggtgagactgtatatgggggttgatggcttctaataataagccaggacctgtcaacttcctcctgttcacaatgtggagaccgtttagattttggagttgaaaaataatgtgataaaatcaggtttttttttgtttgtttgtttttttgagatggagtctctctctgtcacccagactggagtgtggtggtgtgatctcagctcacagcaagctccacctcccaggttcacaccattctcctgcctgagcctcgagtagctgggactacaggtgcccaccaccatgcccggctaatgtttttgtattttttagtagagacggagtttcactgtgttagccaggatggtctcgatctcctgacctcgtgatccgcccgcctcggcctcccaaagtgctgggattacaggctttagccaccacgcacggccaataaaatcagttttaaaacaacttgaaatcatagagcaaccccttattcctttatgcatgctttgcctgccctctgttaaggtcaattgcataatatttttcccatttaaatattgcatttttccaagtggaataagaatgactaggtgttattttgaggataggagatattcagcaaatacttgatcatttattgaaatataactgttttgattgagcacagaagtaaggaatttttgaatcacttccttttgtgaaggtgcatttattttgccactttattccatggctacattctgtaccattagactcaggttaatttatcgttaaaaatgcctgtggtgttttgtttcaatgtctacaaatgtcaaccaagtcatctctaatactttaaaagtaaattaaactccaaatcaactgattatgattctgaggtgcagtcttcacaatgattaggaacttgattatttagtagaattgtgcataggtgtgaacatcaccactcttttctgcactgtgagaagaaattacttcatataaatggaagcatcttatttggctctatgtggtggttttgatggtttttgaccaaacactatgattatagaggtcaatgagctatttaaaataggttctgtctcagaataaaatacattttgttcataactttgccagctactatgtcaagcctatatttactaagggccttcatgaaatgtctgtttggaagaatcagtctgtaatggcagtgatgtgtcaaggaaagaccaaacagccttagtgaatgcattttacctggtgtgggttgcacgtacctgtaacaggaaagattcctttgtctttgggcagtacagttaggctggcagggtggtggaggattctgcctgtgctttccagctcatagcaggatgttcacttttatttacttcctgagtacccttcaagcggtactgttatcagagctgcatttgagatgaaagggatccctattatggcccaaactgaaactctccacaggacacctctgttaggaaggcaggaattctttccaactttagacactgaaaggaactattgcttctttgtgatatgcaaggtattttatattttttactttgatattttaatgcttattactctaatctcagaggaaattttaaaacatactaatgttccatttattccaaatatgtataaaataatttattctttttcaaagagagacactgtgtttaccatctgcagattaggtatgcattatgtatgtacataagcacttatgaacgaatggatgaatgatgatttaggtggtattataggctcttcctttctcctaacataatttgcataaacagtggtctcagaaatacatttcccctgattctttatttgcagagcccaggaaatgcttgcaaagtctgaggttcacaaaatggatctggttggtagttgtgtgcctgtgtatatcttcccatttcttttaaattcttaatgacttttatgtaagtttactttaccactttgatcccagaataccacatattttatggcagggctatttattacttaaagaatgtaaaataaaggtataaaaatgtcttctaggtgaggcatttttagtatatattctgtgtttactttttttttcttttttctctttccattacttctgcctatttatggaagcaatgttttaggcttgttcttttctgactttactaatgcacttttctgactttaatatgcaccaaagttgccctgtttaacagctttctctgtatccttttactaacgttcagtgtcttgggaaccaagcgcaaaacaaagtcatccatcttgaactaatatacgagcttacacctactgacagtagtaaatacaaaattggtgatgctctccaccactggaattccatttaactaccaattcccaaggagactaattcatttaccaacggatatgaacaaaaccacactcactatttcagagagcatattgtattttccctctttcagataattctaacgaggggctgttccacctcacatcttcgatcacatggtggtgagaaaaccctataacttaaaggagaggagtttattacagtaagtataaaacagaacaaaacagctgggcttccacagcactttatgggaaacgtcttctgacccttctataaacaattcctttggtaaagtccccattttatgttggtttgctctgtcattggcgtagagttatggcttgagtaaattcttgttgagggtttcaaggttggcatgggaatgcctttcttttcgagatcttatagtagatgtgtgtaattcatcaattgtggaacatatgccatgctttattcacaaactttgagagaagttaattgccagctatcaccttcaaaatctggcaccagaaattgatatctaaatcatttgagtaaaaattagtttgtaaggctttgccagttactcctagcaaatatattagcttatccaaatgaaaataattttagtgtggttttatgattttcaaaagcttgttatttatgcttcatttcatatcttggtaagcattataggatttcactatatctaaattttggagtgggtgtgagaattaaagacataactaaattgctggagaaagtcaggttataaaaatttaatttgtattttatttgagtagcatttaaaggaaaaatgtgttttctatatgtacattagacttttgatattttatgtgtgttataaagcataatatcctccatatatttactttgtaaagaaaaaaaggttatgaatataacacaaacttatttattcctgttctctttttaaattgaactgttaacaattaccaatgccttgaaaactcacaagagtgcattaggcaatatactttcacaattaattggttattagatcattaacaaaattttaaatgttttttcttctgcttatggtacccaactgttgcataaaagaacagctatgacacgttatttgatgaaatgccagttttaaaaaaccttttttagtttaaaataattgtgtctagtcctcacctaataatcagctgaaagttgttaacttttatatttgagtctaattttgagaataaaaatataagctgcaggaaagtgtattttttcattagataaagcaaataacacatgtttcatgtataagaattttggttgattaccctgtgtgtaagatattcttcaattaatcagttccagctgtttccacaagaaacaatttttctttgggcatgtgtaatagaaaaaaacacatcaagttgggcataatgtgttttttttgtatttcctcttaagcaattcattcaaatttagataaatttcaagttattttattttgaagtaggcaagctatatttatttcactttgtttcaaatgcaaatggttaagtgttttgcattctcatcagtaaagagtcctatgactaaatcataatttaatgatctcttcctaaagagatgatgcaaaatttagatctgaggaaaggattcttatttttatctatttaggctgatctttctataaaatctctgcgggcttcctttgttgttcaaatcataaagatgaaatccatattgtgaaagataatgtattttattatagaaatatggattattgaaataagtcttcacatatgaaatgatattttatgcattgtgataatgtgctttttctctggagttaggaaattgtctcagttttatcagaaacaagagttaggcctttttatttaaactatcatatataatttaggtaaactgaaagaaaaaatattttatatttagcaacatcttttccattttcagtgttctttacttctttataaagatctgagtttctatctggtataatgtcctttcagccttaaaaatgacttttagtgtgtcttacatatagtgtaattctaatgatgataatcctcttagttttcatttatctgaaaatatctttattttacctaaatatttgaatattttcactagataaagaattctgggttgacgccgggcatggtggctcacgcctgtaatcccagcactttgggaggccgaggcgggtggatcacgaggtcaggagatcgagaccatcctggctaacacggtgaaaccccgtctctactaaaaacacaaaaaattagccgggtgtggtggcgggcgcctgtagtcccagctactcgggaggctgaggcgggagaatggcgggaacccggggggcggagcttgcagtgagccaagatggcgccaccgcactccagcctgggcgacagagccagactctgtctcaaaagaaaaagaattctgggttgacaagatttttttgtttgtttttctttcagaacttttaacttgctataaacagtatgtaatgtgttgtttttctctctggctgttttcaaggtttttttatttttattttttggcagcttgattattatgtttattatgtacttaggtggggctttcttagtatcatccttctgaaggtttgctgggatccttgaatctattaatgcctgattttcaccaaatttgataaattttctgccatatttctccaatatatttttatgcctcatctctctttcttctgtggaaaattcaattacacacatgtaaaacgttttgaggctctatacaattccactcccaacccccatccccaatcttttctctctctgtttttaaggctagaatatgtctatggatctagcctcaagtatgccagttcttttctctgttatctcaaatttgctgttaagctaagtgaaaattttaatttctgatattattttttcaatcctagaatagctttctggttcttttttaagaattctatttttctgtttaggtttctcaattttaggttcattttgaaaaatattaatatattattttattccttaagcacaattacaagtgtgctttaaattccttgttttctaagtccagtgtttagtaggtcatctcaggggtcatctccgttgtcttctctttgagtatggaacacattgtccggttttatcatatgttgagtcattttgaattgttttctggtcattgtagagatttcagaatctgtcatgtgctccaaattatattaacttctgttttgactaccaggcagtaaatgtagcagaaatcaaactatagtgtcctttaaagtggatggttgctgaaatctcaattcaattcttttaacctcagcagagctgtttggagactgtcttgctgtcttagttctggctgctgtaacagaatactataagccaggtggcttataaacaacagaaatgtatttctcaaggttctggaggctgggaagtccaaaatcaaggtactggaggatttgttttttggtgagggccagtttcctggtttataggcagccacgttctcccagtgtcctcacataatggaaggggtgaaggagttctctgggacttctttcatgaaggcactaatcccagtcatatgggccccactatcctgatctgatcactccccaaagggttcatctccaaacaccatctcattaaagattaagtttcaacatataagttagggggcaggcacatatattcagtctatagcacccactgatgcatgtttcagaggatagccagggattgggcatcatttacacatagaatatggggctttctccttgactgatttctcctcaacattttccagttgctctgttgcccaagctccgtcccttgcttcttcaagccaataactgcaactttactttcctcgttttatccacctagaatgggcagactgggtcttgatcttccctaaaagctgtaaaataggaaacttacccagtgttgttcccttcttccagttgtctgcccccttcactatctgcctgttttggattactttccagtgttttcaggtacttacattttatattttgtctatacttcgtagttgttttgttttgttttgttttgtttgagacaaagtcttgctctatcacccaggctggagtgcggtggtgtgatctcggctcactgcaacctctgccgcccagactctagtaattctcctgcctcagcctcctgagaagctgggattacaggcgtgcaccactgcgcccagctaatttttgtatttttagtagagatggggtttcaccctgttggccaggctagtctcaaactcccgacctcaagtgatccacctgccttcgtctcccaaagtgctggtactaccggtgtaaactaccacacctggtctatacttcatagttttagggttggttggttctgaaaggacccattattagaaatctataacttcacattggaaagagttctcatattacaaacctttgaaaacataattttattggctgcttcattacaggattgcagaataatctattagtttaaacaatgtgaaattgtcatttttccaggtcagaaatgctcagataatggtaatttcatatggtttaaactagtaattatgttcttagatatttataatttattttatcattgaatatctatgggaatatagagtttcctgtagttcagtttgcttacatcgtatagagtgttagaaggagaatgcctgggtctaaatttatgtacgtctttaaaccccttcaatataattgctatttttgttattaaattgtaatgtaaataacatgtaatttttttgtaaaatggttgcatacattaatgatatttaatatggctttcatcctacaatcgtgtcatgcaattacattttggctttactattttttctttggcaaaatattatcaagttatttaattgatttgtgtttgttccttattatccacactgaatatattcattatggttgttagcttctctacttcatctttgggtaaatgtatcagaatattttaagtacccagaaatatttgagactttcatcatcaaatttcctcctttatccatatttaagactttaaaatctgcttaaatttaggaatttctaaaaataatttcaaattttatcttagattcagtgggtacatgtgcaggtttgttacatgggtatattacatggtgctatggtttggggtgtgaatgatcctgtcacccaggatcatcgagcatagtacccagtaattaattttgcaatccttagtcccctcctcccctccctcagctactagttcccattgtctagtgttgccatctttatgtttatgggtactcaatctttcactccaagttgtaagtgagaacgtggtatttggttttctgttcctgccttgatttgcttaggataatggccttcagctgcatccatgttgctaacgaggacacaattttgttatttattttatggctgcatggtattccacggtgtatacattttcgtatccaatacactgttgatgggcacctaagttgattccatgtttttgctattgtgaatagtgctgtgatgaacatatgagtgaatgtgtattttggtagaactatttattttcctttgcatgtatacctagtaacaggattgctgggttgaatggtagctctgttttaagttctttgagaaatctccaaactgctttacacagtggctgaaatgatttacattcccagcaacagtgtataagcgtttacttttaggaaacttttaagatggcttctatatgcaagtaataatatttgaaaatgtgttctatatttgtattattgtgcattcactcagatacagaaaaaggaatctaagtcaataagtgtttcctgtttggagaaaactcaatatatgggcaatacaagtgttatatataaagctcttgcctggttatgtgaccttaagtgttgtagtatgagctggcacaaaactctctaagtgagaaacagaaaggatatggcataagagagagtaactaatccccataagataaggcaaatttttcatgtcaatataaacagacgatttggaacccttgctgtgggcttactgtactgtggcatagtgctttgaatgcctaagaaggtttgtctgtttatcatattctgaaaaacaacatgaaaataataaattgataggtctcatttaacccctggaagacaataaatccaatgcaatgcttgtaaaaaaactgagttatgtttgtgttagcacagtgcatcacatactagcaacctgtgatttcagtacatgtctgctaattaatttattttgtaggaaaataaagttaattgaaagcatgaaatatggttcctaaactatgcatggagagggctaattggtccatggctttttaaaaaaacggataaaaatatgccttaaaaggatgtcctattataccttagttcaaaagaataaagtccccacccatgtctaaatgtatgctaaaccttaagaatatcttaaagcaagaatagtaaatacctaacacatgagaattatcttttgtataatatctgtgatagaaaacattagtaggtcactttaacctttcctgctcagctccgatgcagggtcaggatcctttggacacagtgtttcagtaagtcactaccaatcagttaggttagtttatgaaatgaagagttttttttgccatgtatacacctcttactaaacaacctataacaagagaataatcttacctagaaatgtaccacgaagaagaattattttgattttaagaaacaggaaaccatcgaaactattttacatgaaacatttttttgtctcacccggctacaaggtcaagttgtattccagtttcagcttttaataaaaaataacctttcagtttatttgaagatctaggtcttggaatataattctcaagtatctgtctctctcctcttttctctatggtgactttattctcaggaaggctctttctaagtggtgataagaagaagggagtttctcctgccttatgtcatacctctgagcaaccctcagttttttcctagtagctcataaatccaaggtaggtttctcattggcttctgttgggtctgatgcccttcatagctttagtccccatagacttaggagtagaaaatattggctggtcgtgcctgggtcacatggaccaggggtaactagaaagcattggaattagcctcaattcggccacataaacataggagatattattccctaggtccaaccaggctaaatgaacggagataaatgcttggcaagcaaaaaacaacaggtattcgtggtagcttccattcttatttttcttaactattcttctgaaattgttctgacgacagagattacagttgcattaaggataaagtttaagcagttataataaaagtctccaaaggagattggctcaaattgaaaggggacattcaattttttatggtattaagtaggttctgatcctcagagtcatgtaggaattcaggccagagtggggtttctttgtcatcctcaacatgagccttttactactgtgggttagtcaaaaggaaaaggagaagtgaatctagatgatctttaagtagatgagctgagagttgccaacagcatttttcctcatgtctctttggtgagaacctagtcctagaaccaaactaagtcaaaagagtgactagaaaatttagtctttaggttagcggccctgtgtccagaaggagaaaaagaactaggccgggcgccattggctctcgcctgtaaccccagcactctgggaggccgaagcgggcggatcacgaggtcaggagaccatgctggctcacatggtgaaaatcagtctctaccaaaaatacaagaagaaatgagccgggcgggttggcgggcgcctgtggtcccagctactcccggggccgaggcgggagaatggcgggaacccggggggcggagcttgcggggagccgaggtcgcgccaccgcactccagcctgggcgacagggccagactccgtcacatacaacaacaacaaaaacaacaaaaaacagattagtgggcagaggaagtggagaacaacctgtggctgccacaagctcttgttggtctttcctttttctctaacatgtttctgttacattgagtggaaaacatactttcaaaaacaactggaaaaaaaaagaaaaggagaaacttcattttggctatgtgtctctgtaaaaagatcagcctttatgctcctggtattactcgctatcccactattcgacatttgtcttgtttgctgcaacagaataataataaataaaattatcttcaaagatggcagtgacttttcatcctgtaaaatgatacaagattaaaaacttggagatttttttcaatatattctcggccattaaccagttgtacaactctgataaaatttctgaaccttactcttttcagatataaaaagaagctatggaagattatgttttctgaggtcccttccagactgaaaagatttcgtaccatgttggaaatagagaggtttagaagaaattctcatcctccagacatatgaggactttctccaacaaataggaattcatcctataactcagttcacaggcctttgagataagacttgggggcataggactttggagcaaaccatcaataggagagaaaactagtcattgtaggcattgctgattggagggtgggaaatccttctgacctgcacaagtaatcaatggatgccttaaagcatgagatttgaaaacacttaacattatcttggctacataattataatgttattaatggccacaaagtttcttagcctttttaaaaaatccagtgaaagtatttgatttcatgacctcccagggctgaattatacatattaatgatccatggcatgcaatacaagattttacctttttagttgttccagaattattgccctttgatttttaatacatatccttttgttcttgtattaaaggacaagttaaaggagtagtgactctgtcaggataactctgcagaattaatatggtctttttagctttattaatatcaaagctgaagtggctgctttgtactttcaaggttgcttttgaaggatctattcctcagtggaacatcctgcttcctgctttttattttttatttttattttttattacagcagttggccggaaagcccctgttgatctgtgactatttggaactgctagactgaaatgccattttcaaaactccagctcttctgctaaacaatttttctaggaatgatgccacatcactagctacttgtatttgccaaaaggcaatactacttcaatggccctagctctgggaatgataccaaatgatggttcaggagggagggagggaggcagtaaatcagcaggaaaagctgaaaaatgccccagcttttaatagcttttatctttttccagatgactggcctctctctcaccttctgcttctattcatgatagggcccttttctcccctatttttgtggcttgatattagtattttcattcgaaacggccgtcctcaattatcagagagaaaattcacacctttcaaagctacggcaatcacatttccatgtgactcataagtatatcttctttctctagcacctaggtgcaactgtgggatgcctgatagattaggattgtatgttgaatgggaaatgggtctgaaccaagtgtcagacagtagaatgggagccaggggagggttccaaagcagcagcagaaggtatctctagcaagcatccgctctggctggggactgtcttctggttccagccttactggaagctcaggctgtagagttgtgaattcctggggccaggcaagcctagatgtgttgcctgcttttgataatgtatcaaaaatatgaactcatccttggaagcgacagctatgaggtgtttcttggatgtagaaatttaggtcatctgtcttccttttgcattgccttaaaaagtacgatttcctttcttggtttatcatttgctggccttctttctttccatccttcctcccttccttccttccttcctcccttttttccttccctagactttccctatctccctcttttctttcgtaaaatttggttgcctgggataacgtgtattgcatacaagctgacttccttactgtccctagtaagctatgtgtggctattatttcttcatttatatgcaatgccagaagcttagaagaatgttatctccctttcagttaaaaactcatagttaagaactggccatcttcttgttttgggtattgtggcttggtactgtctaatatatttggagggtatttgattttttaaaaagctactggccatgcctattgagtttcctactgagcccagcacccagaccagtgattgattaaatagtagctgctcaataaatatttgttttgtaaataatgattctattgtcaagaaacaaatcaccaagaaagaaggagctatatatttaagagtactctgttcatctggccaaaatggagttccgagtcccttgctcagctgatgtttgttcacccagaagatggtaaactcctgagaccaacttcgctttgttgttctcttgtggttccttgaccttggaaatgtttttctacaggcagagtatttccccctgttggaattttatttaatattctatctttgtttctactttagaaaacatgccacgtgaataatgatgcctcaggcaaaagaaatcactccagcagtacaatttaaacttaggacaaatcctgccctcacttgcattcacaatttgccaaggcagttggtaagaactgtgcccacacacaaattgacagaatcgaggccccaaggttagcgatgattaaaatttaaaagtccattcattcattttcaaaatattttattcgattgcttctgaggcagaatcatgagttgccttcgcttttgctgctcccggtggtggcatccaactctgaggatagctcatccaactctgagggtagctctgaggggagctaaatatcctcattgttcaatgagctagatgaaaacaaaacgaggctgtaaggtcaatctcacagccttagtggagtaaaaattagaagtcaataattctcttaccaacaaagaggacttgcattcaacaggattttcaaaagtggtatcctgtaaaaattttggaaaataccaccataatggaaaaaaaataaagtggcatataaatcaaatgtagtgctaaaaattataatttttccatatgaattttggaatcctaaaatatttttatgtgtttgtggattcataaggcatcagaactggctttttgcactgaatatgagtacagaaggctttcctctccaatagtgaattaataaaggataagtaggaaaaacgttacgaaacgatgtggtaacattatagactctgtattagggcaaaaattgtgagatagtagaagatctgtaaatttaagcatgcacaatttgacagcggatggtcgtagcatattttgtaaattcaatagcaagccccaccacgcccttaaatgaaggaaagcaagaagacaatttttaatacgtacatggcaccacacccctctaagacgcagcaatgggagaaaagcagattggcgacctgtgtgtgcaacatgaaccgagtgaaaccatcggggagggggtggggggcgtttcttttaaatgtcgcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgtgtcaggggtgggggtccgctggcatctctcgtgccggcgctgggggggtctcccgtggaggaagggctgaaggtgctccgggaggggtccactcgttatggaaaggaagcggggcgcggtcagggtccctcgtccgcagtgggggtggtccgggcccctcagcctgcacccgggaggagacgcccccttttcacgccccgcccccggtggccgaggccggattcggacagctcggggtcagtcgacggagcacaccgggcgcccgaatccgccgggtcccactcacgcccgccggccgccggtaggttggccctcccgcttccagcctccgccaccccatccctcgctgctctctgaggaggattccagacccccccgtagatctccgccctctctcgggtggggctccgaggtctagctggtctgggggtcagtcccggcctctgtctcccaccgcgcccctcgctcccctggacaccgcctggtgtgtggggctcagacccccccagtccactgcccctgtgtggctcctcctctcaggagaggattctagatcccagcccggggggggttccgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccggcggcggagggcaggtgtgcgtcggcagggctgggtggcccggcagagagggcgccccaggttcagcccctcctcgaagggcgccggcgtccagtcccgctcgtgggagccgcggagcagccccagggccggcgagcggctgccctgccaggcgcgtgcgcgagggcgcgctcccgcgggaacgcgccgtgcgcggggagatttgcgcgtgcgcgtggcgatggtaactggtgggccccccgggctcgctctaggcggaggctcccgggacgcccacgtggcttcgaattccagctccaccatcactgtgatgcgtcactctggactaggcatttaactacgtgcctcagtttccctttctcaataatacggagattatcgataccctctatactgggttgttgcaagactggaatgagatgatacaagtaatttaacaccatagatttttaaatttaacaccatatgcatatttgatgcataataagcactcaaaagttattgtcgttgatgccattactgttagttaatcctcagtttaattacatatggtgcattttcatttctctgcattttcattgaagtaaaaattctgcgttttctaattttggagaataatcttaattaaaatatgaatatttgtactgcacagtccaactcctacgaagctctgccttgcagcagattggaagagagaaactgatcaactgccgatgaagttggcttttcagtatattgatggagagagaagcttaggaagctctttggggaaacttttggtgacaagaaaataaaaagtttatcccagagtttttcttttgtaaatctttgtgttttctctttcacctgcagatgttgcagttgggtttgtcttaatttcagtctctttgtgagggaccaccatttggctttcataatttaacgtggttacagagcctatgtataccctggctttccattttatggccttaagtgctgcagtggatttacctttagtaatggcagaacgtagtgtataatcattccttgcaagctcctgaatattgtgagcaaatcaatggagacaaatagttattactggatgggtgtgagtactggctatggcaactcattaaaatctctttcagggtatgtttgtacccacttcactgcagcacaagactatgatgatgaatatatgtttcccagattgttatctgttgcatgtagacttacggatccttttcttcaaagaaacggctatagatatttattgattcctcatggttatataggtcctccaacctatctgctgataagtacactgtacacttcgtgggcctagctgtaggtctaagaggagttgattttgcacatactatacttattgcatttaagttaattcatctcattacatgaattggttttaaataaatttttaaaatcatttgattattaaaatataggcatttcttggtgaacttgaggcaagtaaagcctgacagatgtcaccatcacaaagatccttagtgacctttacaaaatagagctcacccagaaaaacatttgctagatagaaacctgattttatagttgcttctgaaatctttgaagataggaggttatttgccccaaaattgctttgttgaaataatttagcctgattcgcttttatagaaaaataagggtaacgatcaagactgatttaagattcttgtatttttaaccgataaaagaaaattaagtaatagttggggaactactggtgtcagatttgaaggaatgattgtcaggaaatactgagagtattacttcaggtagcagtgtttggctttgcaagacaaccctctcatcctcactgtgaatatgtcatctttaaaaggtaccttgaggaattagtgtgacagcttctctgaaattcatgtgatcatttacatattgtttcccaggagctttggcattaaatgtttcatttattggaaattattttgccctttaatttatgacagccaacagtgcaatagagtctaatgtattttagaaacaataaaattagcttttcaccattttctattttccctaaaaatctagcagcaatgcacttggaatgcttaagttagtccagagacaaatggtaagagtaggaaaacatgacagattgggaggtgttgagttctgaatttggggacctaattgaaatgcaaaggtataatcaagagaatgaacttgtctctgtactgaggttgttttcagtgatgtactatattatctgattcagtcaacgttccttgttattttttcaaaccaagattgagaatactatattttcaattatgaacattttgattacagtttcattctgactaattcagtcggaagagaatgcaattattatggtcatttacatacaatatgctaagttaacacagctaatgagtgaaagcataatattctttctgtttgttcctggaaaaatattgtgctaagcattctttcaaagaaagattacattattcgctatcattttatgtctatctacaagtagaattggcattgagccttttctctgctattaaagtgaaatctcttatattttggtgatcacatgcctttcctctcaccccttgggggagactggaaacaattctcaatttaattagatatgctgctttcttttttctgtacatctttatctgaggaaagattgtattttctaatttgggaggctgcttaacaccttaaacattactaattactgcagtttattttatgtgtgtcgcaatagtgtagttagttaattatagctttctcattagcaccacgtagagaataatgaattaacacatccctttgatcaaaaaggatttaagtttatcttctgagaataaaagtgttattgtgttactgaaagtcactataattttcccaagaaacaaattggttggaattctgtatcactgggttaggaagctcaatgaatgagttggattgatcacaaagtagagtagagctgtggttgcttggcaacctgacattattctgccatttctggtatatttatccagtaaactagaaaattctgtttcgttaacgaatgttttaagtcagtgcacaaatagaccataactaattgagattttatgtgttgtgggtaaaaaatgatcctgcttaccttctcattgtgtttagatcataaaaatacaaagggacatattccgttttcaattttaaggcattttcctgaaatgttgacttcactttcacataatttattcctagtgaagaatacaacttgtgtatctctttggaagttaaattattagaagtgtgtgtgagtgtatatgtgtatgtgtgtgtgcgtgtgtgtgatgcttatatacataatttcaataagaatcacaactagagtttgaggtgagatgaattctcaaaattcatagtttgctaattgaactgacagtttggtacatttagggtgggtataaatatctgaatcaaatgatgctggcagatgatgataagaatgataaatgcattgaacttggtcaatatataattatattttatgctttgaccagggtttcttctcctggtagtcttataacattctcccttctaatgtttgtttgcatcttatttcccctatagttgtggaggtaggagctctgttgcccatcttctgattcacctcttcctaactccagggactacaattgtgccattttcctatacaacctatgaattttagtgtgcatcacaatttccttttcagactgtaaactccttgagggtatacatttccttttatgcatctcataaactcttaaagtgtctggcacagcaggaagcgaactgttgtggtggttacatgcactggctataaaagtcaggctgccagggttcaaaatctaagtctgtcagcttgcaggtgtgtggcattggcttagtcatgttgacctctctaagactagtttcttctttagaaacggggaaatagccatacttagctcacatgtcacatgtgttcttgtggacattgtatggggcaatctatgcagacagattagtagcacggttttttattgtagtgataattatccttctatatcatgttcagtatgtgaatgaacaaagatagagggacagagcgtatgtgtgtgtgtatccctgtgtatgtgaataactgtgagccatgatcaatggtggtgtcaaatggcaaactgttgattcctacattaattatatgcacatataccaataatgattgcttcacatatttaaaaggttttcgcaatagttgttcttaggcttggctgaaattagaatcgtctggagagttctgtaaagctaccaacccaaatcaattcaattacagtctctgtggatggtgactagaaatctggatttttgaaaacttctagtgcgattctaacacgccctaatgtaccaatattggttaagaaccatcaccttagatttgcgtacgccgtccacaagattgtgttgggctaaggcattggttcacagtcaccctggtgtcatgaaatgtggctgaaagagaaaaaatgctctggcaaacttctgaggtttttcttactaatcttcttggtttaaatagcactttattctctgaagatctcaaatgtgcttttcatttactgtgtataatttcgtttttcaaccaaatgtctctgtgaagatggtaggaaagaagtaattatcctgatttgcagatgaatgtgaatggagtgagctacactgaaattaagtgatttgactagattcatacatttagaacaggcccagataacaagattcctgtgactttggggttttgaatatttctctgttttgcctgcagacttccaatgaggtagggagagttattgtttttggactaaagtactgtgtcagaaaaagctttaaaaatgagactttcatcctttttttggttataattgtgcagtgtaaagaaaaacagatttttattttctttctaagaagaggcaccatagtctatataggagccaaaccaatgtcccttggactttgaacaccgcttgtataaatatttcatttggcccaaagaatgtttaagacaaatttcagccaacatttaaatactggagatttcatgtaaaattcatatttctggcttatcttaaaaggattgatgttctcacagtattggacctgaatgcccaggtggcagaatgccacaggttagaacccagtggtttgtccccttgatgttcttgaaagacatatcttcgctgggtaaaacatggcttcctctcaccttcactttgttcctttcttttatatagatcctactccaaagaggtaattaagggaccttaaagacgggcccacatctctttggatgggattaggggaagcccacaagggctgctgaagcacatctggagctgttactgccccttgtcctgaagggataatgggaaggtgaagttcctggaaggaggtgggagcagtagctctggaagagggctgtcacgtgggacctatggcttttggtagaggaacataactactgtcaaatcacaagacagtgctctgcttctaccccaagatttccagttgcttcttcagcaaggcagtaagacggcaagggagcctattgtagtggtttgtggaggtcagttctcccagagcagagcaggatggaggaaggcagaaaagggatctgaatctgggaagtacgtgaggaatacctagcacatcttgaaggctttacatttgtggaacgtgagtagtggggaaggggaaagctagaattgacaaaaacagtacaaaatagggaatcattaagtttgtattcaggagaatcttcaccactttttctttgtcattcctttcttctttctttcattgcccgaagtgggcatgctcatattcagtggtgtgtttcagttgggactcttaaacttcaaaacaaatttgtccatttcattgcattatctatgctttctaagatgagagctgacatagcagagagaataatgtaaaagatgtattccagcttctatggtaatggttggcatttttagcagaggttcctccctaacaaaagcttttgctgtaagtggtgattctcctgggagggattgtagttatgatgcctgggaaagcggagatacactcaaatgtcagtctggcagctgaaactcatgtaacctggatgcctggatctttggaggaagtatccttcttctttgttatagttgtatcagaacaaggacgatgaaggaatagaccagaatgcactggttgcatcttaatgtgaggaatttttatttccagggactaagagatgtatttcccagagtaatagaatgtaagtggataaaaggaatgtggggattttgatgatctgttgcggttagagttgttggaagttcggttttttattgcattgaaaaccttgctaaaaactgtaaagtgacagaatattagcttattatgggatgccttacatattggttatgttcaaaagaaataacacgtctcatgtgcaaaaggttcagggggaagataaatactgaccttttccaagactgatactggatgctgcatttccatcctttcagaagattgcctctgaagatttctattttaaaaaaaaatcataatgtcttgcattatttgtgtgctttatgctttttagaaaatttttccatgtcatctcatctgacttttacaataacatagtgaacaaaaagaaacaggttgttagcccattttatagatgaaaaaaactaatgcaaggtcaagtagttagctttaccactattccaccacactgcctacagtagtgaaaattagaattaaatcatcttagatatcctaatttgtaacccagttcatagcccactctattgctttcaggttttctttttcctttttctttctttctttctttttttttttttttggagatagggtctggctctgttgcccaggctggagcgctggagtacagtggtatggtcatcgctcactgcaacctcgaactcctgggctcaagttattctctcacctcagcctcccaaagtgctgggactacagacgggcaccatcatgtctggctaatttttaaaatcttttttgtaaaggtgaggtttcactatgttgtccaggctggtttcaaactcctggccttaggtgattctcccacctgcccctctcaaagtactgggattacaggcatgagccaccttacacagcccagatttccttttttggaagaaaagagcaacattgtataactgatagtgaattgttttttaaggaaatctagagtcaccgtataaactgagagctgtctaggggaaaaattgaaaatgttaccagttatattttgagagttgaacgtagtcctggccaaagatagggagatagacttttccaaagcatcctgaattctataatacatgttcttatgtttgtgtgtgtctgtgtgtgtgtgtgtgtgcgcgcgcacgtgtatgtgtgggtcctatgaggcattgtgaccagtcattataaaaagcttttattgatcgccactttgtgctagagacaggaatgaaactgtgccaggcagatacttaaatagccaccattgatcatttatcaagtgtttattatgtgttttgcaatctccacatcagtgatttgaggaaagtactattataacacccaatgtaagctgggcgatgcagacacagaagggtccttgtccaatgtcacacaatatgtcttgcagtaccagagtcagaattcaaactcagaagtgtctgatttccagccccagcagtgccccctcgattagcaggattctccagctatggtcttcactatggactaacactctttcctgttgtccatccaaacttacctgttctgtgtcccattatccatttgtggaaaagtagacataaaggaatcctactgaggtattagatgataatgcatacctattccaggaatggtggcattaaatatgaggttttaaaacctgccagaggtggtggtgcaagcctgtaatcccagcactttgggaggctgagacgggtggatcacttgaggtcaggagtttgaggccagcctggccaacatggtgaaacttcgtctctactaaaaatacaaaaattagctgggcatgatggcatgcctgtaatcccagctactcaggaggctgaggcaggagaatcacttgaacccaggaggcggaggttgcagtgagcctagatcgcaccactgcactccagcctgggtgacagagcgagactgtcttaaaaaaaaatcttaatgcaactttgggaggctgaggctggaggatcacttgaggccaggagttcaagaccagcaacacagcaagactccatgtctacaaaaaatatataaataaataaaaataaaaattagccaggtgtggtcgggcatgcctatagccccagctacttgggaggctgaggtgggaggatcatttgagcccaggagttggaggttacagggaggagacatttgtgttctctccaaaatcaagtcatataagcgtctaatggtctgactcttcctgtaccagaccctgggcatcattatatgtacaaatgaaacttcactctcattatcattgtttatttcttggcagaaatgtttctgatactctatgatatgaatacgcatggatttccctcacttctgggtattatatgtaaccaattgcatttcgcggttggcatttccacaaaggtgtgagtatctgctattccagattaaaatagaaatcgttggcaatggcagatgccatatctcagcattgctgttcttgaaaacggcttgaaaatgacaccgatcataatgatggcactgtctttattagcagccgtcaataaagataaggctttagaagaaaaaaaggcaactctatttcaggcacagccaatatatttgggagttttaagagatttttgagttttttgtttgggatatttacaagcaaatgttcatgtatttttaagatatgcataatataaatagcattctcagatgctgagtggctccaaaaggctcctttttgtgtactagaaagtggcaagaataagtttgtttcctgctttggctagacaggagatcccacttccttggattatacacaatggcttttctataaagcttttgtttgacccatacctgcttctctggaatacacagcttggcttctcaagaagtaagtttatttctgtgttgtaaattcaaggatttttctaacttgttctgtaaaatgcatctgatgacatagtggagaattcatgcatttgattaaaatttaaagatgtaaagaatgcttaaggcatcatacaatggcaaaaaactgaaaacactgcccacaagggtaaacatataggcaataacaattttaacatctatcacctatatctgcatgaataataggctatattgcgttatttgttattgttcactaatttgagacatatactattttccataaagaagatctgagtgaatggataaagatagccaaaacaagcctgtttaaatttgaccttgaccccattttcttcgtgacctctagcaattctcagaggagcaaacttcaaagggtttcaacagtctgctcttcccatgcatacaagtttctgcttgtaattgatttgggctgaatagattttgaacacaattgatttgcttgaaataacattaaaggaccaagcactgagcaattcaggtgcaactcatgcacacttctgagtcaagttcaaataaattggatttgaccttaaccactgtcccctcaaaaaaagggctggcagtcatcagaatgaatgccatccaatcaagtataaaaactggtatgagtggtttggatcagaaattgatctccatacacaagaccttcttttgaaaacttgtaatgagcttctgttttcctgttttaccagctgtaaactgaggaaagaaacattgactgctgcctcccagtggcagttggaggattaatgagctaatatttataaagtgctttgaagataaaggtgccagctattattattactaataaaccattttttctgcagtgtaattttggacagcaggccttaaaaacccattactgtatttaacagtaaaacaatctgccacagcctagtatttactgcctcaattaagcatgcattccacttcctttgcccctccaaattcagaactggtgaggagagacagaaaggagtgtgtcatcatttcccaagttcattgaaatattaggtttgggttgtttgattgtctcggcagaaagctagactatatcctcagtgggagactagttgagctacacttttgtttctgtgccttatgaagggagtggaaggcttggttctaggcctttattcaaccagatttacattgtggtttattatctttgaagattgcattccagtatccgttttggttatttgaatatggtaccattaatgaaactggtttatttgggtggttttatgtgtgtacctgcgtgagggtggggttcacaactaactcctaaaaccgaagtggaaaatggaggtaattctgcagctatcccatgtccaaaagtattaaaaaataaaactggagaccttgaattatacaggatagtttcttagttagtaattactgttatcattatatgatattaaatcctttcaatctgatttattttgatctatatagatgtcctaaaatatcagatggtacagggtagtgtaaatatttctcacgtattgccaaaacaatgcttattttcctctgatgctatttcagtactgcaaataaaagtaaaaaaatataaagttaataaatgactataatgagatgtctcagctttcaacagctacttcaggtattcaaatgctaggccaatatctaaaagttgaacaaaagaagcctcaaagcaacctagatctctttcttggcaaaaattcactaaaatgtaaacacttgattatggaaagatcttcctaattcagtgactatttgctcttaatttagaaccattctaatatgcataattatattatttcagcagatgacaaagtataaactgcaagttggagcagatgagggaaattttgcaaattcattctaagacaaaataagttacatttaatatatttcttccgcaagagagagggatagaaagactagaaaaagacaactcagaaatgactatatgggtgatcttgagtcattaagaaattattttaaaataaaaaataaattgacataccacctataggagttcagatcatttatctgaaaatcttatggaaccaatccttcctagtggtctagttgttcaataatgttaaatacaaattcttaacagaaccctaatcttttttttgtcattattatacttcaagttttagggtacatgtgcacaacgtgcaggtttgttacatatgtatacatgtgccatgttggtgtgctgcacccattaactcgtcgtttacattaagtacatctcctaatgttagctcccctccgctgccaccccacgacaggccccgtgtgtgatgttccccaccctgtgtccaagtgttctcattgaacagaacccaaatcttttaaacggtttcttttacaagcaatgcactaataatgatccaaggtaggtgccgttgtttacagataggattttgtattgcccattccaagtttgccacagagtatactttttattactatcacttagggagactgtttggtaaataccatcaccattccattgacttttgaagttgagctcatgctattttcatcatttgttttgtttaattgtgtatggggaattcaccatatggcttaaaactgtttaagacctcaatagatatgtgttttgcatatgagattcttggggtatctgtagggatatacacaagctgtttgttattaggaagaaaagtacctgaaagcttgtgtgtagctaaggggagaaatgatgaaaaatattctgaatgtagcaaagtaacaatttgtgtaaaatgtgaaggcacatttttccacttacctatcactgaatgacaaactaactcatacctttaaacagtaacttcaaacaacagacattttatgaaatctcatgaattgtaggtgaggaatttaggcagggctccgctgggtgatttcttctgccccatttggtgacaactgaggtaatatggtggtatctcagagagtggctggggtgggctggtggccccaggatggcttccctcacatgacccatgcaatggcaaggagggctgagctcagctgggcccctctttctgtccaagtagtcacagggcctctctcctggtccttccagaaatgtcactggacttttcacacagtgactcagggctttaaaaatctaacttggaaacttaaaggctagtcctcagaccgttcagattcaaaggaaactctcatccaacttctagcagacaaggtagcaagaaatacaaattaagaaagacatgctaattaacagaattattaaacccattgtgatacaccattcactcaccatgtgactgcttacaaagagggaaaaaatatggagccctctgttccaagggaacactcctttccccctcccgacacttcctagagatcttagacccacatgactgtgagaaagaagagtgatgtgagagtgaactttggcaaggctgaagtgccctggttttgtctggagcgagaataaaagtgagaggaaggaggcgtccagttggctgagaatactgttggctaagattctttagcagggtgggcttttcggatgcttttctcctctgatctatttaggtttatccttactcttttccatttatctgggaagtgacttgggtttaagagaaccaggagtatcttagcagagtcaaaagggccacggtgaaccccaaatgtcaggaaacaaggaactgactagattactcaaggcttcactcttgaggagggagagaaaagagctcctgcatttccttctatttattgattacagccacaaatggaaaaggaagcaggctttctgccctgaaataatgatgatacatcgggctgcagagctcctatacctataactctcaaaagcaaatggaaaggagactagcgtgtggctagtaccattattctcacatcttcctgcagtgttatgagagcacagagtaggatgcagggtgaggatagacagcagtagagctttcttgagctgcttattcctctccaaattctctctgaaagtggatgaagaactgctgccatgtctggtgtgggttcaatttgtgctctcattgcttctacttctctgtttctccagatcctaccatcacgttcttccttctgtggcttagccatttttctctccacgcttaggaaccatacatactatcattcttctacctctgaagcattatcccatccttctgacaaacatgagtagatgttttcccctcacagtcttgccaaaaagcacttataaagtattgcaccgtagttttcatatttcaaaaacacttcaacaggcaaaatgcgatatacacaaccccaaaatgctgtgctatgatgaatttagttctgtattggtaatactataaattgcttttgaatgaaagatacaatgtctatatattatttaatttgatacttgcagtaactagctatttaagcaagataggtatcagtcctctttagcgaagttcagtggaaccaatggaacaaacgtgtgggagtggaactggaactcggatgtctgattttgtcttaagttattttaatgacaagtcatttagccaccgataaaaagttacttattcagaaaattcaatcttctggacaagttttatttttacatgacataacctaaaatgttatatatgttaaattctgccgttttagatttcaggaaaacaaatgcagagtggtagaggctggtggtgagaatgagctgagaagggtggtaataaactgaggtttctacaacgagtttgcattaaaaaaaacttgttgggggttctggaacccaatcaattctcagatgtttccatagtctatttttatatagcataatacatttttattatgatcaggcaataaagcaagactgttcaccagtcttgctttagccatttaccatttcctatactctatgtatgtcctttgtctgcttttacactaccataaagcctgcttcaactttcccctcaatacactgagatttatttcttcactcaccattctggaaaattccttgttcagccttctaatcactagacacctgcaacctttccttcactggatttctgcctcgaacagtcactcttctccactaagatctacatgtcaccgctaaaatcccctttcttgcttgtcactttgaccatgatgtcacttacttcctgaaaatttcccctggctccctactgctttgcaggccaagtaactgtcacatttcgtttccactttcagctggagtcagccttcattattcccctctccgtccctgtatccttagagaccctctcctttgactcaacagctcactgctcttgtcttctcaaagctcctgtcttttcacacacagttcctgctgtcttttcttcttaaaacaaccagccattcgacagtctccaattctctgagaagacattcccctaaactcaccatcttcaatacttgtgtcatatctttgtgccaaattctaattcacttaagattttaactggcttactaacaaaatatactaacttaaaatgaaggttttatttattaccttaaatgaaacaccagtgtcaacggcaaacaatgaaaagtaagagcaaacgttactatgatgaaagcaacttgaagtcattgcattttaggtagatatttgtgcctgccccagactctgggcttgaaccctgctctgtcttataaaatagggagattagaaaagttaaattgttattaatgttctattaacacctacttgagactttcaactttttatagtaagaagaattgaaaaataattcacagagaattgattcccatgatgcgttcacctatgtcctgctcagaacacatctaggatcatttcagcgctgatagactgttcaaggagatgcagcctaactcaagaaaaattcatcatgctcctcctctttccttctccagttttgttcccacatatgaacattaaatgaaaatttatgaagttcctgctgagtgaaaatcactgctggataggtgaattccaagatgaaatagatagactttctggcctgaagttgcttactgttaccactgaatatatgcccataaaatattaaaatagacctaaatgccttttctgaggtctggaactctcaaagtgttgtgagcctccaatctaattaaagaactcactcaagtataatgcaaaatagaggatgaaaaatgccatacgaatgtatagataatgttttatgggagattagaatagagaaagattatttccagcttgtgcactgttaaaagtcattaggaaagaggtagaatttggaaagcaaagaagagattgcattgcaaagaagacattcaattgcaatgattatttctctgaagcaaaataagtgttcaagcccaatttaatgagcaattaatttttagcaatattttccacatgttcataatctagtaccatttgaaaaaactttctgatgtgaaaaaaatgtgatttaaatacctgtctcaagttctgaaaggcttcctcacatattataaaacaggagccctccctaatttgagtcaggttagagaaagccaaacataggtggaatatggatacctttactacaactacatttggggagtcaacctaatgcttgcttaatcgcttcacagaaagattgaggaaggcagtgatatccagtatcatcatagggctctttggtgccaataatctattgaggtgcttttcgattgtgagacgaccaagaaattagctgatcccagcagaaaaacagagctccttccttacttttcagctgcgttaatttcttctctacgtttcagagtactgctaattccatccactgatcccttctagggcctggttttcagtcctaggcactcaggtaaggctattctctagacacaatatgcatgtgaaacaaaaaaagagaaaagtaataatgacttcaaatattaggatctgactatgaaatatcagatcttttaactcttgtattcatgtaaccttcctacatttttcaagtgaaaatatttcctacattttttaagagacatcagtgttacgtgctacgttatcaatattattttcttattggccatggaaatgcttaaataattgacttgacttgttaaatctattttatacattgcattttaattacatttataattttaagaaacttcactttttagaaagatatagacatgaatacccttggtattaattagtagtagatgtccttacttctgatagcccttacataatgtatccctctctatgagtgctgtagatttttcacttatatctacaaatacagaagatataacttattaaaagttcaataggaataagtcctcatgttatgagagagtataaagcaatagttagagtgatgtgaaatattataactctgtcttctggaattattccttgaaaagattaattatgtatgcctaatgagataacagtgacaaggtataatttagagattataaagctgagaattgaaatgcctagcatgtgcacgtgcacacacacacacacacacacacacacgtaactgctcttttgcaaatcttcatcacatcaattgtgttgaatccattctcttaggctatacattctcatgctagcaaaatgaaaacttgaaagtaatatgttgaagagatactatgttgaagagattcccatgttgattgcagcattatttacaatagccaagatatagaatcaacctaagtgtccatcaacagatgaataaagaaaatgtggtgtatatatacacaattgaatagtactcagccataataagaatgaaatcctgtcattgtggtaacatggatgaatctagaggacaatatgctaagtgaaataagcaaggcacagaaagactaatatcccacgttctcactcatttgtggagtctgaaaaagctgatgtcacaaaagtacagagttattagtgactccggaatgtatcaaggaggggaggataggaagagattggtcaatgacataaaattacaattagacaggagaaataagttctggtgttctatagcatagttgggtgactatagtaaacagtattatagtttgtatttccaaataactagaagagaggatcctgagttctcaccacaaagaaataatgtttcaggagacggatatgcgaaagccaatgtacacatgtatccaatcattatgatgtactccatagatgtgtgtacttattgtgtatcaattaaaaacacaattcaaaaattgtcatgggtttgctctttttttttgcattacaaagtgacatctatttcttgactacatgctaggtgattaattataaaatggctctgtgcattgaagcatctctttcaagagctttacaacctgacttttgggaaagatacattgtatcttttgaatgattcaatagtgaaatttatttctgagtttaccattttgtgatttctgaattttttcactttcagcatttccactagtgttttatttactggttccacaaatcagtcagtttcatcaaatttgccaactgcaagcctaaaccattggaaattggcataatgaatgttctgagtgagaatatatatgttattaggaatattttaaatataagaaaatgtgatacaaacctggctgccaaaatatggcaaaaatgtaaacaaaaattgatgtgtaaaaaataccactgtatttaaaagggataaaactaatcagatagtattttaaagctgatgtcttgatggcacaattttaaattgaagtgctatgggggatattgtcttactggtatttgcagtttgggctcaaaaaaccagaaactatatctttaagggtgtttaacagaataattctaaatattatagttttctctttcctttttgttgtcctgtgattttaactttgacattcttatgtgacaattgaaaaagtctcttcacttttgtgtattctttctaatgtgatcaggagaattaaaatgaacattttctttcataaagctgagagttaattctgaaacgttgtaccagaatacttttatgaatgaaagactagcctttgaaccctaggagagtcaactctacaccaaccctgtctattaaaaaaagtctgtgcttacagatgtcttgtgtgagatgtggctttaccaaaagtatctgaacttcaaatttctcctatcactgccaactacccatgggtattggcaatatatttggtagacttatttcttctgtaggcatatgatgccatggccaaagtgaactctacatttttaagagaggctgctaaatatggccaatcacaacagaaaactagcatttctccaatttggcagtggtttctggatggcacacccagacttacttccttaagcaatgctgatatatggaaatgccatgatagaggctcagaagctaacactgaattcagcagtgcagaaaaactccaaatcatgtggttcttctttgtcaatattttcactaaggcagcataagatattaaatcacctggaattagttatgtgccatttcagcaaccttttgtgctcagtctgctacaagctgcttgtgctgattagcagtttaaaagtctgcaggggaaggaaattttcagtagcttgattttcccccaccctttggtcctgtgtgcattggggaagaaattaccttctgtgcaattcctgaataatttggtttgattattaatagattcatgctgaaaaaagaacaataacagaaaaaaaattacccatggggttgcagctgtgctcccagatacaaaacagggaaagaaaacaggtctctccaagcaaagggtatatgtgtatacgtgtgtgtgcatgtgtagctctgattctaagaagccattggttcatttattcatgcatcaaatatttattgagctgcgaacaaatcccaggcactgtgaggaagacagatttcctgccctcccagagttgccattactaagaatgttagccaataaataaatctttacgggaaagaaacaaaggactgtgatagaaaaaaatgggaggagaaacttactttagaaaggattatctgagaaggtgcctttcacgctgagccagaaagggaagaaggcaaacaggaaaagagccagaagagcagagttcccagcagaggggaagcaagtggagaggcggtgtggaggaatcaatttggccccatctggaatggacagaaggctagaacctgcagtgcagtgagtgtgggagaaaccagctggcacaaggtgagcttagggcagatcacataaggccttgtaggtcatggacaacaatatggatttaagtgcagtataggaacttcaaaggaattccaacagttaagctagttgatgtaatttgtgtctatatgtatatatatttatatatacaaacaaaacaaaccttggctgttgcatgcagagtagattgcaatggagaggaggaccagttggtattccgcaagggagataagaacagcttaggcttgaatgaggatgtgataaaggggattttatgagcaaggctgttttattattttatttattgtacttctattaagatgatatgggtgctttgggggctgttgtaaattataacccacagcccctgcacaggaaacctccacaggaaacaatcaaagaataagtggttgtgagatgacaaggtttacgatacgtgttttcaggcttcttaatagcagagtgattgggtgatttccaaaagacctcagggctgggatgggtgaaattttgtgagcttctggattggatgagggtgtgctcttgcagaaagaattcctgaatactttctgcactgacagaacctgcttattaattcttacagcagttatgttttagaagatgaaagaccctttccattcaattattgatcataagcatgatgtgtgttgattaaaatggcatgataatggtatcaaatggagtttggatatctttttccttaatatacttttgtgtatcatatttaagtttcctcaagtcagtagagaagatgttacccacatcctcttttccaaagaaggaatcatttgatcattgaaaggtttactgaatagaaaataaattatgttgactttagcacaaattcctgccctaagttttagcccatatattgatgatgtcaagtgctgctaaatgtgttcttcttctataaaaattaaagtttaagctttggatgctaactttcaaatctatgtgaaatgatatgatttattgtgatataaagaatgacataaagaacaaaataatacttttttaaatttatgaggaaaaagacaacagaaaggaaaaatgggcaaagaaagagaacacgtttcatgcaaatcaaaaccacaatgagataccatttcgcaccggtcagaatggttataattgaaaagtcaaaaagtaggccgggcgcactggctcacacctgtaatcccagcactttgggaggccaagacgggcggatcacgaggtcaggagatcgagaccgtcctggctaacacggtgaaaccccgtcagtaaataaaaaatacaaaaaaattagctgggcatggtggcgggcacctgtagtcccagctactccagaggctgaggcaggagaatggcatgaacccgggaggtggagcttgcagtgagccgagatcatgccactgcactccagcctgggcgacagagtgagactctgtcaaaaaaaaaaaggtcaaaaaataaaagatgcaggtgaggttgtgtggagaaaaaggaagagaaagtacactgttagcgggggtgtaaattaggtcaaccgttgtagaagacagtgtggtgactcctcaaagacctgaagacagaaataccattcaatcctgcaatcccattactatatatattcccaaaggaatataaatttttacattatgttaaaaagacacattcatatgtatgttcattgcagcactattcacaatagcaaagacataaaatcaacctaaatgcccatcaatgacatcaataacagactggataaaggaaatgtagtacatatgcaccatggactattatgcagccattaaaaaagaatgagatcatgtcctttgcatggacatggatggagctggaggctattatccttagcaaactaatgcaggacctaatgcaggaaaaccaaatactgcatgttctcacttataagtggaagctaagtgatgagaaaacatgaacacttagaggagaacaacacacactggggcctacttgaaggtggagggtgggaggagggagaggatcagaaaaattaactaatgggaactaggcttaatgaaatagtctgtacaacaaacccacatgacacaggtttacctgtgtaacaaactggcacatgtacccctgaacttaaaatgaaagttttttaaaaaagagaacacatttcagaaaaaaactcaaatggccaaaatacatactaagatagacaacctcatgaatagtcaggggaatgcacattgaaatcacagtgaaacaattgttcatctacatcattgaataatacttagtatctaaaagggatggactactgatatatgcaacaaaataaatgactcttaaaagcattatgctaggtgaaagaaagttacatactgtgggatttcatttatacgatattttggaaaaggtgaaattgaagggatagcaatagaatcattgtttttaaagactggggagggtggttgacgactgacatgatgggaatactgtgtgctgattgtggtggtattaataccccatctacctttgtcaatattcattgaattgtacctttacaaatttggttattgtgatgtatgtaaattaaaccttcaatgatctgattttaaacattacagtgaagtcaggagtggtggtatgcacctgtagttccagctactcaggaggctgaggtggaaggatctcttgagcctggaaattcgaggctgtagcatgggtgtccaaccttttgactaccctgggccacattggaagaagaagaattgtcttgagccacacataaaatacactaacactaacgatagctgatgagttgttttttttttaaaaaaaggtccatgcataatttttgtgatatctgtcatgccaccacagatatcaaagaagtcctcacattcaaaggattttacacctatgcatgtagaatgctataattgcacctgtgagtagccactgcactccagcttgggcaacatagtgagatcccatcacaaaaaagactcacaatgagaaaatgttatcatttattagactacaacaatgaaaatatgtagtacagaatcttgtgaaggtgttaggaaatgagaacgctcatgctctgttggtgtgagtggacagtggcataacctccttttagaggaggaatttcacatcagctagtaaagttgaacatgttttaacccacaccttcgaaagtctgataaacatttacaatcaattgtctctgaagcctactacctggaggcctcatctggatagaaccttggtctccacaaccatccttatcttaaccaagacactcccttctatcgattccaggtctttagataaactccttggactagttgccaattagaaaatctttgaatccacctatgacctgaaatcccacactcacccactttgagttgtctcacctttccagaatgaaccaatgtacatgtttcatgcatttattgatgtcttatttctccttaaaatggataaaaccaagctgtagcccgaccaccttgggcacgtgttctcaggatctcctgaagctgtgtcatgggccatggtcactcgtgtggctcggaataaatctcatcaaatattttacagaatttgactcttttcattgacactaatcatcattgtaaaattaagactatagtaatcagtgcattttgagccctcagttgttcaagtactatcacagaagatcgatatcaacttttgtttcagctccagattaaaaggtgagcctattagagtgtttatgtgtagcagaccctacacttattcaaagaatcatttgcttagatctaagagaaatctcatcccttttacttttaatatcatggtccttgtgaaagaccagacaaaaagtcaacccagttagttccttaaaagaggaaaagtagagggaattcgcatgagcaacacctcagtacttaacagtcattcaaggacttatgcatcaacagtacttggcatttcatgtaatccttccaatgttcttatcagttctgtgtgttcttaccattgaaatatagatgtgcacaccattgaaaagtttaaatcattaatttagtattaagttaacaagaacatagatgctacacctaaacttatccaagatattaatccattgtgccttagtactttattgactcaatttataaaaatattgtatgtgttcagtaaaaatataactacatttaagacataagtttgattttatgacttaggtttctgtaagaagcagcatacttttaactcaggcttatgaatataatatcacttcatctccttacaaagtaattagaataaaggcagcatatattttgtatgaactaaaaagaagtacaaaatattggtccccaaaattaaaatgtaagttcttaactacacatttctatgctatattacttgtattagtttcccattatggtaataaccaagttcctcaaatttagtggcttaaaccaacatacctttttctgttagagatctgaagtttagaagtcctaaaatcaaggtggcagcagggctgtacctttctagaagctctaggggagaatctgtttacttgccttttttttagcttctagaggccacttgcactctagctcacggtcctgttggagctcaggggaagctgccctcttgcccttggatggtttgctgaaaaatgaagccacaataaggcatgttaataagaagaaagcataaaatttatttacccatatgcatgtggagaatcacagagtgattacctaattacccaatcaaacccaaacacttatataacctcctttcagaagagcgggggtagatgggaaatataggtaattcctttgacggacattacatgattactagggaaaagtaaatggatccttgggaaaacgaatagatggacttgtaaatgatttggaagttgaatgaacttcagagacaggcactattttgtagaaaggctgtgccagttctgaatacattctttcactcctgtcttgaaatagataatgagataacagggaagggaaggaaaaacaattttttttttggtggatccatcctatttttatgaagatggggaaaagtctcttctaacgcatattgatttctaagggattttaattcaaagtattcattacttccagggaatcatattttggggtgaaattctctgtgtttttttagtgccatccttcatttttatagccagcagtatagcatcttccaattttcctttctttctgggctctgtcctcaaaacatcttttcagattctgaccctccagcttctcttgtgtaaagacacttgttatacattggcccacccacataatccaggacaatatctccctctcaaaatcctgaatcaccttacatttgcaaagtcctatttccaatgtaaggtaatattctcaggtcctagcaactaggacacgaacatctttggggttattattttaatcagttgctccaccctttaaactcttttctggttgatatatccataaaattaagtgacattcgggtgaagtgtcatcacccatcactatccctatctgatataaaacaatgatacttaagtgaagtgttataggaatacaaatttgcactatgaagttaatattagaagataaacatcctctaaatattatcttatggaggtaagatgacttttgtgtgaggactataccatcttttattcttggagtaatttactattcagaatgtggtcagttttggcacgttgtcagaactgcaactgtgtaaggaataaagaataagacctatctcagaaggttgttgcaattattaaataaattattattttggcatatagacttgctatgtatttactgcagttgttaatattagatccatgtgaactatcaaaaattgtattataattgtccaacaggttcttcttgcccactgcatggatagggcaaattcactgagacagcggtattacagtagagaaagagtttaataattgcaggcccagtgaagcagaaggactggatttattattactcagatcagcatctctgaaagctcagaggctaaggtttttccaggatagtttggtaggcagggggctagggaatgggaaatgctgataggttggggcagggatgaaatcataggggtcaaagctgtcttcttacatgaagtcacttcttgggtgggagctccaggactggttgaattagttccttggtatgagtcacagatcctggtggagtcagctggcctgcccaaatgcaagagtctgaaaaatacctcaaagactaatcttaggttttcacaataatgatgttacctataggagcaattgggaaggttacaaatcttgtaacctctggcacaatggctggttattgtttaactgtacctacatcctaatagagttcaggcccctcccataatcctagtcttgtggccttttattacttttacaaaggtggttttggtccctgaacaaggagggagtagtttggggaagggctatttttatccttgttttaaagttaaactataaactaaatttctcccaaagatagcttggcctatgtcgaggaatgaccaaggacagcttggagttgagaagcaagatggagtcagctatgtcagatttctctttgatatagtttgaatatatatctccgccaaatctaatgttgaaatgtaatccccagtgttcgagattaggcctggtaggagaggtgtttgggtcatgggaacagatcccgtatggcctggtgctgtcctcgtgatatagagtgagtactcatgagatctggttgtttaaaagtaggtggctcctccccaactaagtctctctctagcttctccttccaccatatggtgtgcctgctccaactttgccttctaccacgagtaaaaactccctaatgctcacccagaagccaagcagatgccagtgccatgcttgtacagcttgaagaagcatgagccagtgaaaactcttttctttacaaattacccggtctcaggtatttctttatagcaatgcaagaatggcctaatacatttattgtcataattttgcaaacgtagcttccctgttggctacatcaaattgagggtttgctaggatagaaaagtggaaaatatcaattaaacaactcagagccgggtgcagtggctcacgcctgtaatcccagctactcaggaggctgaggcgtgcagatcacctaaggtcgagagttcaagaccagcctggccaacatggtgacaccccatctctactaaaaacagaaaaattagccaggtgtggtggctcacgcctgtaatcccagctactcaggaggccgggcgggagaacacttgaactcaggaggcagaggctgcagtaagccaagatctcgccactgcactccagcctgagtgacagagtgagactctatctcaaaaagaactcaaaaagattgtgttaggtacttacagactagaagattatgttaatgaatcttttattcattcaacatataattattgcccactgagtatgtaacacgttttctgttatgtttagaaataattatgagcaactcagaatgatctccaccctcagagagtgtacagtctacctcagtatgtagatgattaatagacaaacaataagtgttgaatgttgcacaaactgtcctttatttgatccttagagttatatagcatatttaaacattttgaagtttgaaaatgcatacaaattagagagacatccaataaggtaggacttgggttaatgtttactttcctcaagcacgagaatagtatgtgagaattaagaattaattgttaaaacacatctttatatttctttatgagacaactcttgaagcaaaagtgaaagctggctcaaacacagttcaattacacagacgtatacacacacttatagtcacacacacacacaaaaccaccactgtccaggaactaaacaataattgtactcttctagatatgtaaaatcaagcgaggaacagttaagaataggttatggccaagcgtggtggctcacgcctgtaatcccagcactttgggaggctgaggtgggcagatcacgaggtcaggagattgaggccatcctggctaactctgtgaaaacccgtctctactaaaaattcaaaaaattagccaggtgtggtggcaggcacctgtagtcccagctactcggggggctgaggcaggagaatcacttgaacctgggaggcggagcttgcagtgagccgagatagcaccagtgcacttcagcccgggagacagaatgagactctgtctaaaaaaaagagacacgttaatcttaactttttttgagagagtctcgttccgtcgcccaggagagagtgcggaggcacgatctcagctcactgcaacctccaccgtcaggttcaagtgattctcgtgcctcagcctcctgagtagctgggactacaggcatgcaccactatgcccagctaattttttatatttttagtagagacggggttttaccatgttggccacgctaatgttgagctcctggtgtcatgtgatccgcctgcttcggcctcccaaagtgcggatcccaaagtaggattacaggcatgagccaccatgccaggctgaaaattctgtattctattatatattatataatagaatattttatatatatatacttatatattatataatatataattatacacacatatatattttttaattttattattattattattttttctgagacggagttttgctctgtcgcccaggctggggtgcaatggcgtgatctggggtcactgcatcaccgcaacctccaactcccggattcaatcgattctcctgcttcagcctcccgagtggctgggattacaagcgcacaccacgcccagctaattcttgtatttttagtagagacagggtttcaccatgttggccagactgttcttgaactcctgacctcagcagatccacctgccttgacctcccaaagtgctgagattacaggcgtaagccaccgcgcccgacctgtagtacctatattttttatttttctccaatcttttaatcttttaatcattctccaaaatgttgcctttcttctcaatgcttagcagacaatttgataaacaaggatccttttctaagtagacttcatataggagagttttcaaaacagaataagaagggcatattattccttgtcaaaatattttcttgttgaaaatggaaagtttttgctaaaagctgaaatgcatggcagattaatttatgcctattacttcaggtaaataatttcaccaggagtcttcataggtaaaatgaatgtttatgcttgataaaaaagtagcagttgttgatttcaacaggtttaagaagcgtaaatgttgtccacctcttctttccatcccatgcacatcttacttttactctagtaactaccacccatgaatgtccatctattaaacccaagcagagagtagtttttaaaatattcctttcctgttttctgttgaactattttatagacaagctatataaaaaagaaacacaaggaacaaaaaatgatatcttattctagtgaaggaaatccaaagttggggtctagaatacaaatacacctgtgtgcaagctccagtgatgccagttcctagtactggagagcattgtgactctgagcaaaagagggaagacaaacatatgaacagaaaacctcgtcttttctcaaacatcctcaatgactgttacatgaaaatgaggactatcaggctcatatcattttcaaagacaataggtgatatgcatgtggagaacaaatacaaaaggcatgcatagaaatcaaaagtgattaaaaatagtctgaattctggagacaatagcatgtgtggacggacagatgctacagatttaatgctgacatatcagagatgaaatgtcagctttctttattaccagtagctctcagcttttcaggcaaatcgttctttgtactctacgttctttctccttatggagttccttcttgatgcctcttcctacttcttcacatctttctactccttgagatacctgcactcattgcttgcacttctgttagtgattttgttacagtattgtgctgtgtgtttccaggagtggagccaaagtgaaggaagcccagaaatgcctgtcaagggagactatgagatgataacagcactcgtctttttccttgtgcttcttgcagttaacacccacatctatctatccatctatttgtgtatctctgtgtctgtctgtctgactatcgatctatccatcacccattcatctactcatttattttggcatacagcttttcgatagaggcaaacactgcctaatggaattgatctacaacaagaccatagctggagtgaaagaaccaggactcagaagttaaaaccaaagttaatgttattggaatgtatagtcttaaaaacaatatgttttttaaggacaattttaattcaattaagtgtgcaatgaaaacacaggggaatgtttgaagaatcttttatcttttacccaggtgatgtgcttttcgacaggattacatttagtctaagaggtagaaaaacgtcaccaacgacaccttaaaggcttaccccaaccaccagaaaaatatttgtactatttccttcttaaactttgcacaactttttatgtagatattaagtgttcaaggggatccctgcacatggatgaagtcatgtttgcatacactcagtgtaaatatgtgtacacacacacacacacacacacacagcaggggaaatatttctcaaatgactacacttaggttactttccatctctatttattttcttctgtggaataatgcagactagaactaacataaattgaatgctcatgagaccacacatcttcacatggtatagagtgtgttatcgcagcaattttataatggctcattaacccctgtgagaggccagtaatatgggatagcaacggatttctatcaactccatgagggagataagtaaggtggcatcttatgtagatttctaaatcctctactttgaaatcagctcaatggcatattttaaactcaaaatagaatgtcttctggttcctaatggttgatttaatggtggatttgaccatatgtgtatcagatgtaaaaagtattgtccactaagtggagtaaaaaatgatcttttacagaaggaaaaaaaaactgatttaaatctttagattctcatgggatctcattaaggttctctttctttaatacattgtgcagcctaatagttatcagcagccctgcggtgtgcattgctgataggttagtttacacaggattaattgtgtaattttgcaagcaaccagcacagtgaacactgatttttgcattagccccatgtgttgtttccaaggggactctgctttctattttaaggtggtgttacatttcacttcttattaattataatttctgctagcatgttttatgcccaatatgatttattaaaaatccttcataatgtttttttcctaattgttatgtccttcggtaacttcattaattttgagcactgatgtgtaaaaaatggcaggagaaaatggcattcacagaaggttctctgaccagccagtttccccatgcccccgttgataagttgccacaaatcttttgctaaaatacagacacaaattcagttgcagccactccaggtatgcgaagtgaataatcagtgcaggcaacaacctgacaatactacattcctcaaaccaaaagaatgcgaatgttcaaagaagtgttggctaagcagaactcagtccattttccacaatacgtagcttagtattttccagaaatacttgtgtattcggaagaattagaggaaggaaacttttgtttgaattttccacataatagcttagttcaatactcagctactacattttatcgactcttggtgggattatgaaatgcctattgaggtttcagtggaatctttatagctggacttgatattcttttacatggttttgaaaaaacaaaacaaaacaaaatgttgactgtgcacagtttagaacttaatctttaaattctttttgccttgaacttgaaaatcaattatctgtctgtgccccaccacctcttccctcatctcagccttcacgagataaaatttctctccctccggagcacatggtctctcaaaggggaagagtcacatctccttgtctgtgcagctgttgcttcgttttgtttagggtggatcttctctccttatccccgtgagtttctatagtattataaaggcccaataaggttctgtacaaagtgggtacttaaaatgtgtcctgagtgacaaactggcccccactggaagaactctttaaaacactctgttaccagagcttcaaaaagggcttgtttctgaaggatcaaaggatctcttgtataataaattctgagcattcagtacataatgaagagaagaaaacatgtcttttaagctcctatatgatgcctggattatgtgaagagatgaaggaagtggtgactctttctggcttttgtgtcattcacattaaacaggaatagatgaaagcaaaggcttaacactgacaaaatcccaagtaggcaggctctgcatccacagcctgttcacacattcataacaaaccaccagctgatgacttgaaaaaaatatgattttctttctagtgaaagactgactttgttttgtgttttgtgccttttttaaacatctaccttcagaaagtataaaccttttttttttttgacagagtgattgggttacaatattgttacagaaggactagaattagaatcacaatacttgggtgccacacttgacctttgtcacttgttatgtatgacactaaggaagtaatttagtctgtaaattaattttatttttcatcatttataaataaacctagtaaaatgaacatgaatagttgtttcaagggtttaatttaaaaatcatttttgtattgtggtaaaatgtagactcttatattcttataggcagattgcaataaaactctactaagcaattacactagattttatttctctaaattaaggctgaacaatctcttttttcagttccactttgtctgagtagtttgaatggcccagatcagagatgatttttgagactgttgttattgtgtttgatagattgtgctcatgaaggcacgtgcatatttatggagaaagaatccttagctttccccagatgctcacatgtgtttgtgatcctaatggggttaagaacccttaacctgataatctcaaccaattttcctttcacattaagtgggagtcctactattttagtattaagtaccagaagggtgaattttatatgttactttatatttactatcggttttgtctaacaggaattttgtgcagtaaaatatctacctttcaaattccctgggaggagaaagacaatgcatactggagatatgaacacttttccacaatacttataaaaaataaaaataattaccttggtgatttcccataattaaggcagatttttttccttcctccttcctctcctctcttttttacgttaacaccaccaccctcatcattaccactgccacttttctctcttccccttgaacagagtagataattgcatatgtacaatttcctagagaactgaagcaggcttagcccatagttgaactaagtttcaaagtttgcaaagtaagactggattaactatattttctgctaagtgttggttttaataaaaaaagaagtttatattcattgaaattttcagttgggagtacatgttttaaaaccttatttcttccttttttttttttttttttttgagatggagtctcattctgtcacccaggctggagtgcagtggcacaatcctggtttattgcaacttctgcctcctggttcaagcaattctcctgcctcagcctcctgagtagctgggattacaggtgcctgccaccatgcctggctaatttttgtatttttagtagagacggggtttcaccatgttggctaggctggtctcaaactcctgacctctggtgatccaccctccttggcctctcaaagtgctgggattacaggcatgaactaccacacccagcctagaccttatttcttaatctctgaatgtgtttggtgtgacactcaactatactttcagcttacctagcccaatataaattttattttaatgaatggtttccaacattttgactctcctcatgttaaaaaatctctggatttccttatatttgatttctgtacttatcagtatttggcaggaagacaagtcatggcaacaactgatggctgacgagacgttatgcttggaattcgtatattcatctccttaactgagaaggttttggtgtctaccattactgacctcactgtgaggaggcaccggagaatcatgatctcattctgtgtattggcatgtcattacacattattaatttggtcttttgagtgacacaactgtttttgtatatcggtgtgtttgtgcactgtccctggagctctttgtactaagttatttttatttcattttcattaacaatattttgggaattgtcattgaatttgtaccttttctaccttgcactttacaataattagcatattattatagtaaattagaagtttaataattaaggtaacatttagatcctgtcaataactatagcctactttattttttgaacgttttactatgcccctttgtaacagttttaggttttttaaagagtcattagagtcacttatttatgctctgctgattagctatttattttcacagttttacaagttagatgttcgtacttagatattttttacagatcgaagtttctatttgctcatgagtagctataaaataataattatcattaggttagatattttctgtgttacagtttgccatttatatattctcattgccaccctgtgagtgaaatgaatcagaggttgttagctccagttaaaaaaaaaatgaagaaagagaccttcagagaggttggctaaatggcttgctagtaagtgcctgagatggtgctgttctgttcatttaactttacattttagtctagaattttctctgttactccacttccttttctactcaaagacctttttataaaagaaaccagggagcacttaaaatttgttctctaagtttagagctggactcaaaccattactggcaaaatcaatctggtcctttctttcctccttttttttttttctttctctcataatgaatcaagacatccagcatccttgaaaccttaaaggtatctgaggatacaaagataccaaactggagttatcttcctgacacataaatctgatcttgtcatttcttactacaaatccacgatggtcttttacaagataaagtttaattatctgagcatgacacctagggctcttcacattctgtgcgatccaacttttcagcctcgtctctttttattatctattgcttgcccttatacacctcatcttcagcctccaaaatttcatgtatcttcttgactgtgccctgctcttttaggtttctgagttgcctctcttgcttttctataccagcccccaaccccaacaggaatgccattctttcatttgtagcttgctaaactgggtcacttacctaaccaaataactatgtggctttggagaaaatactgtttttatttcttagcttgtttattttgatgtaaaaaaatgtaacgcatgatcattaaaaatatatctattacattaagtcatcttcaatttctgcttaccactttcttcccataaacaatggtagcaagttgatgtttttctttctaatgttatttctcatgtagacattgatacatagtatttttcataagagcaaaattaagctcacattctataaaaaattttgtagtgctttatttcacctaatattatacaaagtctcagcattcaatattctttaaaaacacaactttttaaaattataaacttttctaatacataactatattctacatatttaattatttctctattattgggcacttaggttgtcacccaaattttattgttataaattacactcagtaaagatttttccattggtagttggtgatatattaatatgtttaatccaaacttagttagatttctagatctgggcatactggccaaatgaacataaaaatctatgttagaatatttaaagaagtcaaaatgctcataatattatgtagagataaatagcatatcatttttacgtatgtaatgtattcatacacatatctgtatgtgtgtatatgagtgtagctatagcactgggtgaatattaatatatcaattgaggaaggaaatacactaaaatattattttacagatgatgtccattttattaggtatatgtgtgtgtgtgtatatatatatatatgtatatatgtatgtatgtatacatatatatttgtattttaccaaatatctagagtgagaatttgttacttttagaataaaacaaaactcccacaattatccaccttaaccaattgctgtctcctacaaatcctttccaaccagacttcatgggtagaaagcgagtttctgctggtgaaagggtgaaactacttgaaaattatttattgtctcccaaggttcactgcagcatgagacgttacgtagttatcaagactaaaatacaaagacagccctgaaaatagctggggagtgtgaaaattagtaatatttaaagtactgaaaattagtgatatttaaaggaaaacagaaagtttagctcttggtttgctttgggagaggacgggactctgaagcccccatgctggtgaggcacggatcttggagggtggtcagaggttgaaagccacttgagcaaatactcagtccaaagcagcaggtgcaatggctcaagcaggaaacagagtaatatcctgagattggctatgtttagacaagttcctattttggggacacagggctccccattcatgggtgtgccttgagtgcagtgccagacacagaatagtcaagtaatatgttcttggatgaataaacaaagaccctttgtacaatgctctgggacagaaatgcttcataatagtgatgttaacatcttttcacacctaaataagcctaaaagacttccaggcagttttcacatgtatttcagtgtgacttaatgatttataattctttttttattactattattattattattatttgtaattatactttaagttttagggtacatgtgcacattgtgcaggttagttacatatgtatacatgtgccatgctggtgcgctcacccactaactcgtcatctagcattaggtatatctcccaatgctatccctcccccctctttctaaacattattaaaaatatttgtgtcactaatcttgcggccataaagaacaagagtttgctttaaaggtgtactgatgctgcgataacacctatggcaatatttaaggttatcaaaattataaagctccatcctggagaaatggtcatgtgacattaggcaatatgtaacttcttcatgccttagtttggtcattgttaaatgaaggacattaaaaaaaaagcaaaaccgtatctacctcatgggttgtaaggataaaatgagttaataaaatgtaaagcacttaagagagtgcctggcctgtagttagccctgtataaatgtatcccattatcattaccaaagaagcttgacattggtattaacttgcccacaattaactggtgtgatcaggcattagttcaaggtggtatctgaggttactatcagatacattttggactatataggaaaacatagtgcttctctataaattgtttgcagaattactaccacaaattttaatggccttctacttccaggggaggccatctctatttgcattagaaagtaatataaagtcagaactgggtcctatttgagatctaaaagattatctatttgacttattcttaacttacaacattgacatttttgcttattgctttcaagactgtttcaaacatgatttctttcggtatactatctttgacagtagtgagaaaacaagagatgcctctgccgtcatactccaaggtgggaaacagaggactagcacctccagaagagggcctctggcttctgggaggtggggcttttaagtttcatgatttggtattggtgctgggatctgagttttcaggtttgactatgcaacatgcttgaaacatggcctcaaggattgtttggctgcctcagcattcatggtgggaagaccagcgtctgaatgataagagatttggaccttgtgtggcagcatttggtctcaggccctgctccgcctgcttgatattctactgtgatgaattggctatagctggtttcccaggagctttgtcatatccacattcgactgcagaaaaaaaacaggagttaactaactttcccaaagtgacacagctagtaagtggcagagcttattcattcactcaagaaaatatttagtgatgacctgttttgtgctacatgctggagctggatgaaaaccccaaagtgtctgagtgttactgatatcatcaatcagccccaggtccttctaggtcagccttctatagggaagggaagtgttcttgagaatgtgtcttggttctccatgatgttcttggacagtagcaatgaaatgcatatcctcatttctatgaataaactatgcctgcactggccaaaaatgtgtctctccgtttttggaagctatttatttctttaacatatatgatctattatagtaatataattctattgtgtacgatttgccctcaatttatttctggaggatttcctgtcttccaagttgtaacaggccaaggttgtagaaaacattatactgacattttctgtggcccttaacattttatttcagtctatctattctttgtattcatctttccacactaaagatttctaatgtttctaatcttcctctgtgtgaatcccatggccccagcctcttaaataatgtagtgcctttctctgtacctccttcagtcccattattagagagtttttaaaaaataatcatagacttttagggcaaaaaaaaaaaccttgtaaatagcattcagttgaaattctcatgtcgtggataaggattctgaggccccagttagttaggaaacacgtcattaatagggagtgttactgacatagcaaggaatcaaactcgttaggacctctgacttgccttggaatgttctttgctgatatctctctattacgctgttggcttctaatatggtttggctctgtgttctcacctaaatcttatctcaaattgtaatccccatgtgttgggggaaggacctggtgggaggtgattggattatgggggtggtttcccccatgctgttctcatgatagtgagtgaggtctcacaagatctgatggtttaaaagtgtgtggaagttccccactcactctgtctctctgctgccaccatgcaagatgtcccttgcttccccttcaccttctgccatgattgtaagtctcctgaggcttcccaagccatgcagaactgtgagtcaattaaacctcttttctttataaattacccagtctcaggaagttctttgtagcactgtgaaaacaggctaaaatacagcctcctttagacagttgaatatagcttaaaaatagtaaaagactgaggtataatcagtatggagtccttttctcaaagtattttagatgagtgatgcaataagaaagagggtctactgtagataaaggcacaggccttgaggttacacacattaggttcgtatcttggtgttgacatttattgtcattgtaactttgtaaatcatacctaacttaattgaattcgtttaatcttatgtaaaattaaagttagtggtacccacattaaaggtacttgtattacgtgagattatactaaattattaaatatgacatctgacatataatctgtcttcaactgatattagaaaaaaatcacatatgatgtttagtggagagtcaatatctgtgatttagtaaagaaatggtaaaactcgtgatcagaaataggggctatttctatttagaatgctctttcagaagtattcttagaaaaagttgaacatcttcacattgcctatataaggttttgctgataaataattcccaaaagccaacattaacaaagtatcgtattttttctagttcttactttattgtacatcattttatgttagacatattgaagaatttctgtctgtgtgttcatttttgcagtactagtagcttataacctagggaatattatgtgcctcatgtatcattttcctttttaaaagatacagtcattcaaatttgtattgagtattttggcacacattttgagggtctgggcctccatgatttgaatcaagaactgattcctttcgggtaaatgttagctgatgaccaaaaaagaggtattttcaatcccagtttcttaagaatattgacctaaatattgactaaaagctgaggtgctcacagccttttctagcaatttaaaaaatcactcaaaacctccagtgtttaaagatcaattgagatcagatacattttttaaaggaaaaaaaataaaaaaaatagccagttttgatctcaaatgcatacacatctatgtagaataggcattttttgtcaacatatgtgtattaagcaaccaatatttggcaatctgacagcaattgtgcttgagtactaggaaggcaaaaattaataagatcatttttccccgacctggacttaaggaactcaaaatcttgcataaaacattgtaaagaaacccttttctggccaggtacagtggctcacgcctataatcccagcactttgggaggccgaggtgggtggatcacctgaggtcaggagttcgagaccagcctagctaacatggtgaaaccccgtctctactaaaaatacaaaaaaaaaaaaaatagctggatgtggtggcgggtgtctgtaatcccagctactcaggaggctgaggcaggagaattgcttgaacccaggaagcagaggttgcagtgagccaaaatcgcgccattgcactccagcctgggtgacaagagcaagacttctaaaacaacaaacaaacaaaacaaaacaaaaaatcttttttttttgtcttgtgagaataaggcatgtagctgctcacacatgtagcttatatagcagctgtcaaggttcatatgctaccacgtggggtactgtgtgatttcctcctgatggctgagttgagtggggactgtcaagtagggggaacccggagactgatctcaagtgtccctcccggcttcactggacatcatcaatcagaacagtgatgtggctgctgctaccgcagctgccccttgcttatcacagagcaccggctagatctcagcctagtgctaagcaatttttgcatgttagtaccattcctccaagccattctgcaaaacagatactattatcccttatttaccaatgagacaactagagttctaaaaggctacttgattagcttacgatcgcacaacaagtaagtgcacacttgctccgttttcagtctgtctgtcccttttttctctgctgcagcatctcttttgacagacactgtggtggtaatgtgctccctcctgctccatgaagctatgacattcatacttgtgactgtaaggtgaaggaactatgaatactactattaattgatatgtgtagctttaatgcattcattctttaattcatctaaacagtatatatataaaatatatatattttaaaattattttttcataggcttttgggaaacgggtggtatttggttgcgtaagttcttttatgctgatttgtgagattttggtgcactcattacccaagcagtatacaatgaacccaatttgtagtcttttatccctcaccccactcccaccctttcccccaagtccccaaagtcattcttatgcctttgcatcctcatagcttagctcccacttaagagtgagaacataggatttttggttttccattcctcagttacttcacttagaataatcgtctccagctccatccagggtgctgtgaatgcggttaatttcctcctttcatggctgagtagtattccatcatatatatttaccacaatttctttatccacttgttgattgatggacatttgggctggttccacatttttgcgattgcgaattgtgctgctataaacatgcatgtgcaagtaccttttctgtgtaatgacttcttttcctctgggtagatacccagtagtgggattgctgaatcaaatggtagagctacttttagttctgtaaggaatctccgtactgttttccatagtggttgtgctagttgacattctcaccagcagtgtagaagtgctccctttccattgcatccacaccaacatccactattttttaaatttttttcattatggccattcttgcaggagtcaggtggtacagagatgtagttttgatttgcatttccctgatcattagtgatgttgagcattttttttcttatgtttgttggccatatgtatatcttcttttgagaattgtctattcatgtccttagcccactttatgatgggattttttgtttttttcttgctaatttgtttgagttccttgtagattctggatgtcagtcctttgttggatgtatagattgtgaagattttctcccactctgtgggttgtctatttattctgctgactgttcattttgctgagcagaagctctttaattaagtcccacctatttatctttgtttttgttgcatttgcttttgaattcttggtcttgaagcctttgcctaagccaatgtctagaagagtttttctgacgttatcttctagaatttttataggtatcgggtcttatatttaagtccatgatccctcttgagttgatttttgtataaggtaggagatgaggatccagtttcattctcctacatgtggcttgcgaattatcgcagcatcatttgttaaatagggtgttctttcccccactttatgtttttgtttgctttgtagaagatcagttggctgtaagtatttgggtttatttctgggttctctattctgttccattggtctatgtgcctagttttatacaagtaccatgctgttttggtgattatggccttatccaaagagtatatattatgttttattatggtgccaggcagtgacattggtacaactaatatatgcccttatggaactcaagatttcttatgttaaatacagaataaaggaagtaggaatatttatagctgttaggcctttagttaattttgtctagatggagtttcaaattacttatgatttgttgtcagttcagtgcataaggagaaatttatcttataaatagcttagaaaggagtcatgtcataaaatgacatgtctcaaaatgtcttgtgaagccaagttttcttccagcatggcaagcaatcaccatttctcttgctgagcatctaatgaagtcataggtttgatgtagagggtatgttgtgtgaaaagtactactttgaaatattagataacttcagagtcacaacatgctcatattcagaaaacaagtgaccctgacttccgctgatccgcagctctcatattacaccagccatgggtaggttgtttgctgagtgtaccctcataacccagtttttactgtatcttgctcttcagcaagtgctgtttctccttccagtatacttctctctggtttttttttttactttgcctcaagtcagtagagtttaatttaactagtttttttgtgcatatactatattttctttcagtcatactttttaaatcttagttacaaagcacacaaccaataaggacccaaatgttgtttcgccttaaattactttctttttaatattttctttttaatattcctctccattcttgttttacatttggtgggtatatttatttgtatctcttaagtaaaagaaactaagggactttgaaaaaaaaacaacttttcactaataacagagaataagtaagacgttagtatctatgtcaatggtggtgagggaaagggtaaatgctttctagagtaaataaattcaaaggattgtatgtcatgttaatataacaaaaacaaaattagaaagacgttttcttagattatagtagtgtattgtgtatatacccttatctaatagtgtttgagtctatccctccactatatgtatatcctaaattgtacagagacactagtatgctaaaatttatcataagaaaagattaaaaggagagaaatgtttaaaaatgagatgaaaaaccataagtacatgtgtgtgtatgtatatatatatgtgtgtgtatatatttccatatttcttgtttcattctaaaggatggtctgtgcatctctttccagagatcatgcacctacaacatgaaggaatgaaagaaaacctaataatacagagactggctgagcgcggtggctcacgcctgtaatcccagcactttgggaggctgaggggggcagatcacgaggtcaggagatcgagaccatcctggctaacacggtgaaaccccgtctctactaaaaatacaaaaaattatcccggcgtggtggtgggcgcctgtagtcccagctacctgggaggctgaggcaggagaatggcttgaaccagggaggcagagcttgcagtgagccgagattgtgccactgcactccagcctgggtaacagagtgggactccatctcaaaataaataaataaaataaaataaaataaaataatacagagataattcttcatttacaataaacactaagaacacatgcacacaaacacacacacacacacagagagagagagagattagattagtagcaaggaacttacatacatgattaatgtgaatgccttctgaaccaaagctgaaggaagcagatgagagctctgtgggcgtaggctgctgctgtgagcatacaaataagtttgatcatagctacagtctccatgcctaatgtcaaacaactgtcttgaaaatcctaagtgagagtggggtgggtaattcagcacaagtactgatctctgttgtcatgaatgtccttgacagtggtaagaagtggggacccattgggaagagccacctgaggtggcttcatgacatgatggattttgaagagatgtcttagacagatctaatgttagaacaataaaagtggtaccatggctgtaggagatcctgaatgcatgacattctttatcactgggataaagaacattctagattaagtcatgtaacattcacctcagcaaatggaacagcagggtcagcaaatctcattttgagtcaacaaatgcaaacattgcattatttcttttccccactgagagactgtcgtaacacacataggatgctggacacagcaacatgggagccaggttctgtactcttctacttaggtaaacttctgtcagcccgcagaagtcagtgaacacaattatattaaaacaatgtgtaccatggacccattggtcagaagccatattaaatgcagtttcatgcatggttagtcatccataaacatttctgcttgtaataataatgcggtcagaagtaggccttgtggggctgaaaagaggttactaaacaaaagtattaaggacacagtctgtgcagtgtgtcacttggtcaactggaaagcagtgacgacttttcttatacttgccagggtggaattcttctcagtgtattggtgtgaggttctctccggaggcattgcaatctgtttctaactacttggcaacagcttttggaataaggccaaaaagattgtcaaataatacacagagtggaaatgagctgtttgaatttttcagccatccttccttttcttagggccaaagatgtagttttataaatctccttaattagtaatttctaccagaatgagttagaattattacatggaatttagctcttctgaatgatgttcagtcattaagttatgacagctggtatgcaaaaaaatgttgacttattccaatcgttctgatgcctaatagaaagtagagttttttaaaagcatgttcatgggatggcattcaaaaacaagcttaagcaatctttctgagattgggagccaatccttgagacacctgggaatgaacagtaaaaggattggatatattggttgaatcagtctcctcatttcacatgttgatgttttaagagataggcggcttggcaaaccatggtgagagatgacctcttgagttgaaggcttatgttcactctgtagttcagaggtctgatctttcaatgcttcctgacgaagctctcctcgttttggtccatatcgttttattttgaaagattagtcacagcatcagacagatgcaagtagctattgtgccagacaggtcaggagaaccgctatgtagaaatgcttacagttgtggtctgttgcaaaatacgtgaattcatgagagaagacacatcgataatgttttcaatgagaagtgtaattacgtggctgctttttgcatgcctgccctctctcctccttttgttccttgacagaaattcgcaggaccccttttttagcaacagagcaatactatagcttaggtatttgagtggaaattttgaggggtgtggggagaaagaaaaattaaatccatttttttaaacagaaaatgtaagaattaatttaaaagtgactcaaatgataattgtttccaaaattacaactttctaatctatccctaggtgctgtaaactgcaaaccataatcctgtcttaatactgcaaacaaatcatagtggaactaaggggaacttaatttactggtaagagtattttccttaatcagttgttttatgcatttttgattgtatttaattattgcagtacatagggcaggagtcacaaaagataaggataaggagacgttgcagaacttttgtcttcactacggtcttagcgtagatatggaccagatatatcatatagtgaaggttttttttgttttttgagttccattaaattgctggtttatttttgaaagagcaaaacccttaccttaaagttatttttcttgttggctgacctgttggcatatttgaaagtggcatatttataatatttatcaaaatgtcatttttaatagaaaaaaatagtttcaccactgagatttgagaaggttgacttctaaggaggcttgaagtttcagtgagaaaacctgtattttcagggggttaacagagctcacgcttcatagtctgaacgacttacagcttcagtcactgttccttgaatttgaatccgtttgaaatctgacctgaatccttgattggagttttttcaaattctttgtgcaacaccaagctgaattataactaatttcaaagagtttggaacaataagaaaagttcacattggaaggagggccaaacacacagtgatgtagttctaggtaagctgtttagctattttgatgacccattttgtaaatcataaaactggaataatagttgtaactgcctacaggtgcagcctaaattagattattacgataatgaatattagcactgggtttggtccatagcattgtgtttggttcagtaagtgccaataattagtatcacgactagtttttaaagacaaaataattggaggaaaaacaaaaacgagtaatttttttctcaatgatgaaagaatggttttcttactttctcaggagcacattatgtcaccaagagaatatgcactccagaagaaataagatattacttggtgcatgaagaatttttttctatgcatttgttgcaaatgggaccttaatacaaatataaaataatgaagaccatgtggaaagagatagaaaatcttggctttatgggttactgttagcatacctggttcctggtaacccccagcggccttctaaatgaatgcaggccataccaagaataagtctatgaagaaactctctgtgctttgaaaaacatttgatctcttctctcatccactggagtggttttgccctccactatttttagatcttcacttgggaactttctccaagaggggttctccatacagactttctaaccacagggcatctgaaagtctcttgtaacattaaaaatggtttgaagtatattctaatatccttagagaaaactcttcccaaaacctgattaatcaattcctttgatgatgattgtgtgggatacatttattccattaaaacacttttatgatttcactttaaatgaatttctagttcataagaaacataggtaaatcttctgagatagtaatgaacaaaatacaatacccagggtattaaattttaaaaaagagattatcatactactatgagaaactgtaattgtggttgtgtcatgatgatgtattaataattatttctcttgacattatgaaaatggatggtaacccgcaaaacacccttcttgctcgtagccctgcattctttcctgtattttattgaattatgtttatttcttgtgttcctcttggtgattgatgaaatcattatttaattctacaaaataagttcccttaccgtcagttttcattgtgctagggaaatcagccatcaggttccaggaagggtttgtggaatcgtagtcataaaacacccatacccacacccacacacaaacacgcatttacctaatcttcatttttcttttcagaatctcttgtttggaaatttcctcccagaatacccaacctctcaagaattttaaaacgatggagtaaaataatcttcaagctctgattagattacaacatatgaatgctaattttgtttttacaggtttcaacacccaaatttatctgaacttagggcacaataagcagtttaactgttagaaatcttatgagattgagtttgtgcctatcagatgaatacatatttgtatataacatttcaattattgctacatttatgtataatttatccaaaagcgatgttatccatgcatcttaacagaaggcttaagtagttgaatgacagggactacatttttgctgcagaagatcatgataaaacatgtgctgtgtggtcaccttgggtaatgtgccgagactgcttgatggtacttatctctacacactgcatctcatactgatttatggatttggatgacttattttatgtcaaagacataaagagagtagagaagagagaatagtattttcatttcagtcttaaaaaagttctatcctatgagatgttaacagctgccttctcttggtggtctgtgaagtttttataaagatattgattattttccaatgacacacaaatctactgctagagaccattcaaatgcttagttacaccagggcttggctcctgtaccctgaggaggacacgattaaccaaatcctcctttttaaatgttctcaggacaatgagctgcacatacggcacaaatgcaatttgcttgaccaatcttgcctctgtctccttctatctccgtttacatgcttcatgctcagttgaaattaattctctacacattggtctcatgaacacatctttgagagcagagttcaagttaaatttttattttcatcattacctctgagaacacaatctggggcatattagacgctttgtaagtgtagaggtggggagaaagaagaagaaagagaggaacagaaggagggaaagattttcctgatagatcactttctggacactttctgtgctgagaagttctgagattgcctctctggatcctgctatcttggcagtcttgctaagagtttccatttacacttaaacatggttactgatgcgtcttaatgttgccttaactatcaggtttctgatagccccacatagccaagtgggaccctggtcaagaagttcacctctgttaaataaatatgcatagattttcaacatctcttcacatgcattcagaggtgatgaaagattccactggatgctagaacattgtgcataaataatcgaagttgtatgctcttcagcaatgatgctaccccatatcctttttttttctttcccatgatatgaggatatgagtgcagcagaactagctccatgcccttgtcccagaattaatcattcctatccatatttgatgtctttaccttttaaatatttatgggctgttatgttcctttcttgttgttcacccactctggggacattcagaagcctcacatttcttccttagccaaacaccccattcccttcatcctctctcagctgttctttggattacctccaaattgcatacataattttggtattgaggtgccaaaaatgcatttgtttcaactggagttttattgaagttgcttttactcaaatcaagtacacaaataaatttgatttccaaggcatgaaaattcagttaggtctccgaagggaagctgaggtatacttatatttcattataatgctacaggtagattttaagtcactaggaaaatgacatctcaaaatcaaaagattatagaatgagcactatatgaagaattacattttaaagcataggtctgtgatcattttgtaggtttttgttgttactgtcagtctattggtttttattaataattttattgaggtataactgatacacaaacgacatatttaatgtgtacaatttgatgagtttggacatatccgaggactcatgagactgtcactgcaatcaaggtaataaatgtatttattacttccaaaagtttcctctgtccctctgtttttgtttgtaagattttaataggctcaagctcaatcttcatagcctttttttaagttaattttttctttctttccaaattcagaaggcagattcatttcatcaaaagaaaacagttcctcagttgctactgcattgcagagaaaagactgactataatcaccattaaattattaaagaataaaagatactgaaacccagcaaaacttgggtgatctctttcataagcagacacttttaatcttatattgacatttaaaaggactgttcaagtagcaacatgacagactgcacatataaaatgtccatgaaaatatgtagcacagctaaacaaataactcagagcaaaatccaatgaaaggagaaaattgtgtttcctcaagaaaatgctatttttgccctaaggcaattcttgctggagaaaaataccatgtaaaacattgacacaaatcacagacatctcttctaaacagtggattttattggactgcacacgcgtgcagagatttggcagatatttgaggtcttggaaaggaaacaaaccagcgaaatatatcactattatcaccaacacaactgcagagggcaaagagcagacacatctcagagcctagtgatgaagcagggcattaaaaactaaatcaaagcctctgatcaaaggctaatttagtctgtcataattgacttgcagtggaaggaagcctcatgcacaaagatcaaagattagtgacttcacatttaccacaacatccccaccctaaaggagggaaaaaaatcagaaagaagaaaggggaaaaaagaagaaacatgtcaaagctcactaagaaccctgtgcaatgtaatctacctttcttaaggatagcatgcattattagaaaaatgaaaatgaattttattatggcatgtttgagttctaccttcgaaagagtgagaaactggcactattggcttaagtaacttatttgcaaacaggcattattaggcagtgccttttgctgcagttgcttccctttatttgtagcccttcaaatgcatacattaagattctcttcacagttgcaaacagcaggtaaataattgtatatttgagagactattgcctattgaatttaagttggtcacagactttggtccatggtaacatactaattgttaacttcctgttaaccagttatatcaagccttatgtaatttttgttgtttcagtacatactgtgaatatagccagctccctaactctgtatgaatattatatggggaggaaaaaatcctgtttctctattcttctaaaatctgtacctggggactgtgaattaaactaacaaaagacagattaataggaaaaaaaagcatactttttttttttgagacatgtctcactctgtcacccaggttggaatgtagtggtgcaatcatagctcattgcagctttgatctcccaggctcaaatgattctcttgccttagcctcttgagcagctggcactacaggcatgcatcaccacacctggctaattttttatattcatagagatggggtcacactatgttgcccaggctggtcttgaactcctgagctcaagcaattctcctgcctcagcctcccaaattgctgggattacaagccacaaattttatttgatattagtaatttaatttttacatgcggagaggatgtcatagtaaagaagtgaaaatcaaaaaagcaattagaccaggtttgtatactattttaactaagggtgataaattgtgtagaagtgacaagacaaaggaaaagagatttaggcttctaggagcagttaattgtgagaagttaagtatatgggcaaacctagtggaagattagggttatttttagtaagatttgtctgtgcagatctatctcagtactgagtttctatctccagtgatagtggttgtcctcctggtacagcagtgggaacggggaagaccctcacaaaaggaagtgtatgtcctccttttaggcctatagtggggaggcaaagagctctttctgtgtttgctgcttgctgactgccttcagctcaaagtaaaccttattgccaaagtggcatattttggggtgtcatattctgatctctttcagttcctatttattatattctcctgtcattatgctttgtatattttatgacattttaaacctgtgccatgtgtaaaatgacagtgaaaaggaaggtaatcctcttatgaaatgtctttctagttgtctaattatagggtgccctattagtttgtaggaattaagcattttcaaaggcatttattcaacgattgtttttgtgtggctgttaagagccacagggttgaagatacagtcgcaaagagagacacagttcttatcctcatgaagcttataatcttataaaggcagatatgttattcaagttataatgcaaacaaatgtaaaattgctgctctaataagcgccagaatatggtgatttgacctgtggtggtcagagaaagcttctctgagcaacaaatgcctgatcagagttgagaagtaaactaaaccagaaagtaagactagaaggatccatttgattgggaactttattagaatgctttcatttttcttgagatagatgtggaatccatctgtgctggggaggtaaaaaattagtccacctctcaggcagaggacagacagtgctgtagataatgcactgagaatggattttagttccagaaaaatatgagttccagctttaactcagcaacttttcggttgaagatttggacaaactagtcaacctctctgaacctgaggctgctaatccgtaaagtgggctcataatccttatctcagataatcatctcaactactgtttgttatcagtgtcatcaacatagtgctgatttgcaatgtgatcttaggcaaaccattttatctctttgagtttcaatttcacacttctttaaaatgggggatgttggattaaatggtttcaagatttctttcagctctacatttccatgattttgcaagcaaatgtaaagctggaaatttctgtctagatatcatgggaagcctatatcctggaaagttagaaaaagtgttgtttttggaaagtagactttttaaaagaggcataattccacccgttagcgattttacttatatttctttaatccacacttagaagtttctattatcttagattcaattttatagcacatatttcttctactaaaaagcctttaaagtgtttcagtgggatgtttaatttcccattatggttggtttctcaaatcattccttttgtaattgtcacatttttacagtcctgtttaaaacaaattcagtttttcaactaaaaatatcaagctgagttggaaatcgaaatccaaggactgcaaaatcaaatgataataaaccaaccataaggttaaactttccaaccaccacaaacttagagaccaccagaaatttgtgttacttgtttcttataaaatatagaataatcttttgaagattcttgtggccaaagtaaaattttattacatttctaaatctagaaaagggaaaactatttttaacaccttgttacttatttaaacataaaaatatttagtttgattggagcctcttcttgactctattcatatttcacttaaattactattgttttagctatacaaagcctgcttctgattatatttatgttaaacatttaatctttctttgtagagccacagatttaagaaagcatccagatatatatatatatatatatatatatatatatatatatatttctattttggtattttaaaatctcactcatgttttgattaataaatattcttaagtgctttcatatttatctttatttttaccttaggaaacacatattgaatatattaaataggtataccaggtgctattgtccttacgttataggttagaaaactgggccattgatttattcaagttcgattgtatatttatcgagtgaaaattagatctcatatctcatatcttctaacttcttattttgcattgccttactgattttccaaggtaaggaagaacctacccaatcaaatgaaagagtgctgacatgaattaaatctggttaaatgtctgatggtctgattgtcctcaatgattatagcattcaatggtattttattttcatttacccttccatttgtttcttataatatttcccattttgttagcctatgtatagatacgcttttcattagtgaatgtccaattatcatgctttcattttgggtggaagactgattagcatggattaattaaggtaattaaataattatagttactgtaatgtaactatatagaaatgaacattagcatggcctaattatctagtatttaggaacatatgctttggagaggtgatttaagtgggcttgaatttgaccttccatacttactagtaatgtgtgcttttacaagttacttaatctttatgagccttaatttctcatcagtaaagaggagatagtagtccttacagagtttatttttaatagacacatttctataattgtactatattttacacatggtaaactctcaatattatgattaacaatgcttttattgccctagccatggctgtgatgtatctcgttatgaaccaattatgctcccttagcaccatagttatagaggatgggacagttaatgcgagttaggttgtttagagttcttctctgaggagttattgaattgatgctgaagtaacagagctggtatcagagaattataccagtacgtaagcaagaaagaaacaagaataagcaagaaagtctcagaggtgtttgggtttctggatccaggggtccctgtagctggttccctctctaccttttctgtagtttttgtatgcgggccaataaagttccataacttgttagtttagcttagtttgatttgggttcctgtgacccactaatgtaatccaataatacaacatcttaaagacacatttctttgtcttcaagttaacatgtattactcacaacagtatcttaatacttatttatttatatgtttattttgtttctcccaattactaaaatgtaagctctatttgaacaaaaacttgcagtactctttcttcagctgttggaaaacctctaccacctactaggttctcagtaaatattggacgaataaatggataaaaagagaaagaaagtgacacttttctaaaagtgctcctgaattaaaattgcatctgtatttcttcctgaatagactagaaaaggacacaaatttaacatttattgagaacttacactgagctagccatcatgttagatattatatacattttgaacttgatgatattatctccattttacgaatgcacaaatggagggacaaagagctaaagtcaaattggtggcctcctggttctctgctcagaccgacctttgagaaccagctgcttccccagctgctgggatgtgtccagtagctagcacttaacatgttagccctgctttagggattgcctcagtggaagagagtactcctttgtgcaatgtcatgtcccctttccagggaagcccacatctaatgcctataaaggcccaacaccatcagctcagctctggacaactcctgcttccgaacacccctttcccataaattgatctcacatccctcactaataaacaagactcttcttcccagggaaaccaacctgctatggtaattttcaaatatctctgcccaagctagtgacatggcctctctaaggaggtaaagtgggctgatacccactgaaactgggagaagtatagttccaaggtatgatctgagaaagggctaggtattttctagggtcttaaagataggttttttagctgggatacagggagcttgtgatgagatgattgtcagggcagcagacatcagactatgcagggccttataagccacgtatcttggtgcttttgtgctgctataatagaataccacagactggataccttgtggatagtagaaatttatgtctcacagttctggaggttggaaagtccaagatcaaggcatcagcatctggtgagggccttctcgatgcttccttcagagtggaggtagccatgcctcacatattggaaagtggaaaggcaagctagctaaatcctgcatgaagcctcttctaaggcctttctgagggccttaatcccattcatgagggaggagcccttctgacctaatcacctcttaaaggcccaccagttaatactatcacattgaccattaagtctcaacacttgaatttgggaagggatgcattcaaaccctaccatcatgcaaagaagccaaagttatatttcctattgtccctaccctttcctcagataccaggatttgcctatctccatctctagctacaattgttctgaattttggggcccgtttttgctgcatgaatttgtatttgaattcaagacttgaaagattaattttcctttcagaatgttattcatataccccttcattcttaacctgctcactggtttcctaccataattacagtctcaaacagtggttgcattctggcaaaacgatgttttgagttagagttgttatgcagttagtcagttgtttgtagttaaaaagtctctttcttattcactgaaatgactggagtcccagctgctaggattcaaaggcaacagggaagacttcctagagtttcatgtgatcataaaaacctttccagacgttttaagtgattatgatttctatgctgcattgacttacaattagagatcattcaagtaacttagaattcagtaacttctaggtcacagagaggctcagatacacactgttgacagccttttggtgtctttgtatgtgtgtgtgtgtgtatacatacatacacactaaactgtactgctgtatgtgtgggaaaaagtctaaatactaagcatttttattctattttgggcaagtatctgtgctcaatggatgcaagttggtatctaaaatctaaaaaatgcaaagataaatggatcatctgtgtacttcaagctttattttcttgcatagttttttcctagtatttcctgacaacctagaacagtagttctcgcctttgactgcctattgccattgcccgtagcatattttagatctaaggatccctggacagatactctaactcagtggatggagcccaggtagctgttttgtttgtcgtggtagttgctctttttaatgtctacccattgtcctgtaagacaactagggttgtgaaccatcggttttttacactatctaaaaggaaggtgtctgtggattgaggatatttcttaccttgcctacttccacactttcaactttctaaaattcctgggattcatgctcccattccccaaagaatagtgagttacctataattatctacagcatctatcaataatgcctttagttcctcactttgagttctgcttagagctaaacatattctaagcgaagtaaggaggtttcatgcttctgtgtatgcataagtgtgcctgacaaagagatgaaacatgaaagtgaaacaatactgataaatgaaatttaaaaatatagtatgactttgataggtagtctgtattctggcacttcatgaaatctccaaattattgtatattaccatagcatgcaatttttacttatagcatggtaaagcagagctcctccttttgagtgatgtacagctattgcaccactctaagtggtaacttaacacagaataaatatgaatagaattatctagagttgtacaactcagtacctttggtttggaccagagaaaaaggccttagagtagtggttttcaaccaggagtgatttcgcccttcaggagcatttggtaacatttggaaatatttttagctgttaacgctaatgagggagagacttgcacctggtcagtagaggccaaagatgctgctacatgttctgcaacactcaggacaactgaatgcccaaaaagaattatcttgccccaaatggaatcatgctgaggttgagaaactctggcttagagaattgtattagtcatcctggcccataaaattcccatgaaaatttgggaacgaggggaggattcatatgtatctttttggtattgtatttctggcgcctgggagcttgctcagcatgcagtagttgctaaatatgtttttggatgactgagtgatggcatgatttgaatcagacaacattattttaccagccttggaatctgggcaaaagtgggctgcttaggagcaaagacacgagtctgtgtatttctgtggttgcctttccatggaaattcccattcaaggggatacctaatatgtaaggattaaagatgcctcctccatggattttccatggtgtctcacattctctaattagttattccttaaagttttgtccacctgtgtatctttagtggtatggcttcatgtcacctcaaatatggaggcattagctttgtttagttcagtatataccagattatgggatggaaaatactgaagggatatcaaatgatcatacgtaatctaagatataattaaataataaacttacataaagcatttaaaaaaaatttagttctctttcccttaattctttcaatatttcaggtagagtcaaaggctggttttgtgctatcatgattttataactaatttttaacaccatctccttttcttcttttcttcttcttttttttttttttttgtgagacagagtctctctctgtagtccaggctggagtgcagtggcaccacctcggctcactgcaacctccgcctcccgggttcaagcaattcccctgcctcagcctcccaagtagctgggattacaggtgcctgccaccatgcctggctaattttgcatttttagtagagatggggtttcaccatgctgaccaggctggtctcaaattcctaacctcaggtgatctactgcctcggcctccctaagtgctgggattacaagtgtgagccactgtgcctggctctctttttcataaagagacagcaaacctcaaaatcagagattcagcttgccacaggtctatttaaaattgtttttatttcaattcatgtattttttatgtaaagtagtgttgatttcctgtttatagcagtggagaacatattaagatattttaatttaaatagaaaagtaagccaattacaaataagtgcaagtagcgtacagatatgaaaaaaatcataatcatgtcacttaaataggcgaagaaatcattgaatttatttgttttgttaacattgtctcatcttgaaggagaagatggaatctggagattgcagcttgaatggctccggaagaggcagcatgttcggtggattggatgtgtttgcataactgtgggaccacatgggaggtgacgcaggaaggctgaaagaggacagtctccaaaggagggagcaaaccttgaaaacacctgcagggcccttttaatggccaactgcatcaatttaaaacgttcacttgctcccccatggctgtctgtccaggcagaagcaacatgacctctggtttgaaaggcctctcagattaagagagaatattgtgtcttggggaaatcaatcatattattatgaatcatagaattatgagtcatgtgttataggttgtttcaggcaacaagacctcagatgtccttcacttcaaccactcttgggatactgaagggtattgccattgcaatctgtggccaacatctacttccacatctctccctcttggggctttcaagtccaagcttggagtcatgtttgtaggagcctcaaatctctctctcaagaattttcatttgttttccccagttctcccctgtggaaccatggaaattaaaatcgaaaccctgttctattactttcacatgtttgaagatagatttcatgtcttacttgagccatttttttcttcaagaaaacatttccagctccttcaacttttccgtccatgagataatgtcagtccctttttccatcttcggaccttgcctctgaataagctcagcttgtctgaatcagttttaaatagaagcatttacacttggatacaattttccaggtgttgcttcagtgggacaaacgaaagtgagacaattgcatctcttgttctagatatcatacttctttatccataccctaaggttactaactttttggcaatttcatcacattgttattaactaagtcccctttttttttttataaagaaggtactacaattatcacacacctttattttaaacgtatggcaacatctttttttttttttttttctgagacattctccctttgtcacccaggctggagtgcagtggcttgatcacggctcattgcagcctcgacttcctgggctcaggtggtcctcccacctcagcatcctgggtaactggcattacaggcacatgccaccatgcatgtcttttttttagagagagaatttcaccacatttcaggctggctttgaactcctgggctcaagtgatctgcccatttcagcctccaaaaatgctgggattacaggcttgagccacaatgcctggcctgcaaatgtctttctaataaaagtatgtgtatctgtagtgtgtgtgtgcacacgtgcgtgtgtgtgcttgtgtgtgtgcgtgcttgtgtgtgtgtgtgcatgcgtgtgtgtgtgtgtgatatagtgggggtggggcaggagataggaattgcagagaaatacgaacagttaaacataaagagaaactggaaatttgaaaatatatgaagtgtctgaccccaagttcaagctgagaagctaggcatcaattttatttttccttagcctgtttttaaaaaagtattttttcaaagtttggtccttgagccacttttcagcatcatcttatcagggaggcctttcctgtatgtcccattgcttgttatctcatccaccattccttgctatctgctttaccctgctttattatttttttcatagctcttattacttccaagcattttatatctttttatttatgtattacaaggcttcatgaaaggaggtactttgtttttttaccactgctatttgtcacaacgagtttattaaatgaacaattgaataataagtaaaaggctaacttgggatgtgattgcatattcagatttttgggtcccaagctgggcctacagaattagaatttctggtcatggggcccgtttaacttacttttctagtgtttcatctgtgttctaaaattttagcaagactgaaagtgcacacaatctcagtgcactaaacactgaaaataaagtgtaatgagtaaatttttgaaatatcagctgggcatggtggctcatgcttgcaatcccagcactctaggaggccgaggcaggcctatcactccagatcaggagttcaagaccagcctggccagcatgatgaaaccctgtctctactaaaaatacaaaattagctgggtgtggtggcgcggacctgtaatgccagttactcaggaggctgaggcaagagaatcacttgaacccaggaggtggaggttgcagtgagtcgagatggtgccactgcactccagactgggtgacagagtgaaactctgtctcaaataaataaataaataaatgtttgaaaaatcaaaaaatggccatcttcctttacattcttaaaggaaaacataagtctgtatcaaggcattagaatataattatgctgactgtatattttaagtcaactgcatattactggccaactggagatcactatctattaagacataaaatttgctataatgtaggtttattatttacagaggtaaaagggccttattcaaaccttgtttcgactatgatgatgtcatggttgaggattcactcccaggtcctaaataacattccgataccagcacgacagcagattcacacaggcacaggcacttgcagactgccatagcttaccaaacaagacccaggtagagcatttcaaaaagctaccaaattgacacagctggggtgtagtttgggaaatttgttcaaaatgctaatctttgaagttaaaggtggaaagaaaaagtctacataaaaaccttccttggaaggagaaactcttatttccctataaacttcattactaacaaaataagggaggagagcaataagaaacaaataagattaaggaagccaaatggtttttaaatgagattattttttctcagacttttccacaaggcgtcagcagctctgtaaccaccagattgtcagaaattagcctggttttttttggacagtttgagaagccattccgtcggccttatttattgtttattaaattgattctacttgattttttgcagacataaatgagattcttctgaatgatgacctaagctgttaaaccttataataacatcactagtcactacttctgcctctcagctagtcagaagggcacaccctatggctttacccttgatcattgcacaaaaagaagagccaagactgtgtaacccaagtgtaatcaaagttacataaaaattacttagtgaagccagcccctgatctgtttagcatcatgtttactaatttattttttttacctccaagtaaagtacttggtcttttttaaaaaagaaggaagaagagcaaaatagagggagggaagaagagagggaaggaagaaagaaggaaagaggagaagagaaaaataaaggaaggaaggagggagagagagccttctcaaattcagaaaataatattattttttctattatgaagcatcgtggaagaaaataaggccagttgctacttaaaagtaagcattgggctgaggttaagaaatcatattctatctttaaattttatattcactacctgtttggcctcaaaaagtcacaaactcattgagctaagatcttacttgtaaaatatatgaattagagctgaatgatattattgaaacattccagctttaaaaactatatggctctttgattattaatgtaactgtcagatttgaaacacaaagatagaatgagtatttagaaacataagccacagacttaacaaccagctctcaaaatcctctcctcagtatttataaagagaaataaattttgaataaaaagataataattgggaagtacaattgttactgattataattcaatcttcaatgttttactggaaagaaattgaacaatatatgttcttaataacttcctttagtcaataatcgagtttgggaatttttagcagcttgagtatatttaagcccagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcccagatctacacagtactcacagggcaggattcacacgtttaagcccagatctacacagtactcacagggcaggattcacacgtttaagcctagatctacacagtactcacagggcaggattcacacgtttaagcctagatctacacagtacttacagggcaggattcacacgtttaagcctagatctacacagtactcacagggcaggattcacacatttaaatgctaagggatgaggtatcaggagaggtataagacaacagggagtggtaaggcctggtacactgaaaaacaggattgttttaaagcaggaaagccttgctcaactctggaagaattttgctgtgtgccaaagcagaactagtcttgtcagactttctaagttttggaagaaaggacagaaatcagcatattaatgttaaaactcataatgtttaagacatgggagttcattcaagccttcaaagacatcactgtgcaaactaatcaaaacacacctgtgagtttggccccactagggtttctggagtttccttcctcccattcaactatcaggtgaactacaattaggtattaatccttaatgacagcttcctaatgaccttgtttagctatttcaagaggatccttccctaaagtattcagaatcgccttgaaacatgaagaccacttcaagtgctatgcaaagtgagggaaatttggagagtagattcttctgaagatttctctgctaaataagttgcactcaactgaaatccagatgtgccagcactgaagctccatcgcaggcaaggccgactcattgaccccaacttctgtccactcaagtgccccgagactgctggtgatttagcaagtgaactccttgccagttgtaagagctaattcaatctcatccccagggtggtataggtacattaagagttgcagctcttagagtagttaatccggaaaaagaaaaaaaaaagccaaagtgcttgctgaacatttaactgaaaaatttctcatttgtacctgatggttctgaattttgtcaactgtttctttgtatccttgtgacacgtttcttatttgtcatgttttcttttaagaaagaataatgtgagggaaatgaaatgttcatttgttactggaaacttacagtgatgagatgtggtgcataagacatcataaaatatccctcatttccatttgcatttgtcactgctccaaatcattcacgtatctctgtatctgcgtctgcatctagctttgatttattcacataattgatgtagagtgacttttcccaaagacatgaattatattaaatttttgatttgtgcatgtatttgcttttgcatatcttacttttagatttttatagctcttcgaactcagagaacattcaccacatctatattggcctagggaatgttgaaagaatgattttaattatgccacatatttttgcactgttcttatctacaaacaattgtataagctatgccttttgaatatattcatgtgctgtgccagatagtagtagtgcaaaatgctaatgttgattttaaaagaatgacctttccttgtgtgtttctttccagtgatctgcttatctaagacggatagtattgatggactgcactatcacagtcttagacttgcagaaatgccttggagttttttgtttgacatttctttgtcccttgggtactttgctctgactctgtcatttagactttactgtaaggataaccaattagtagttaaatgagttgaaggagtctttttatgtactctattcaaataacactaaactcactgtcacatgaataggagatatgaattatttctctacgcacttttaaagcaagcccacacagtaaatgatattgttcataacccctgcctttattgctttcttccctacacttagggacttattttaaagaagaatttatagatcctctattctgtattccagtagaaataataactcagtaggaataggagtatgtagttttttttaataaacatataacagaatggtagaattagttttgaaagccatactctgaaggaacaacaatgagaatacttgctgggaattcgcctctttaagaaatagcagaggactgccaaattaacaaaatgcccctggtctgtatcatttatacatggtacagatatatattgtggacctactgtgttccaaacccaaagattgaagaagtaaattctcacttcctgtctttgacatattcagaatttggaaatatttcggaagctagaagtcaatactcacaatctaactcttagaatgaatgatccttggtcttttaacaaaggacatctgactaataaaatagtcttagagttgtaggagaaatgtgtcattctggacaacaaagaccttctgtctctttcgcaatggactgtttgcgtaaaataccagcgtacttagtgaattagacatctacaacactgtgtaaacattcctttccagtcattgcttcctggtcagtcatagagaccactttgaagtgcctttattttgaacactaggaaagaactacaggagagccacagccctctgaagtagtaatttttgtaaatttgcgaataatgatgttacatcacgtcactgggacatcaaacctgtctaatgtgcactactactcccacactactactgctaaggcaacaaccatttactaggcttattggccgtgtgccaagtgctgtgtttatttcttattttcataggatatgttatttaattaacgggtagctaagagagagggttccagagacaaactgctaaggttcacattcttgcttccattatttgctagctgcatgaacttagccaaatttctcaacatttctgtgtctcaactaccttatctataaaatggaaatacttgcctgataggtttttatatgattaaatcagaagatagtggttaagtgcttagagtgcacagactaaatgttcaatttgctataacatttctataatatcactcaatgaatatttgctataatattttcatatctcttactgatcactgtaactcaaataattgtgctgtcttattattcttagtttgcaagtgaaaaactgaagttcacactaaccttttagtcaaaaaatgcactaaatttctgagctgaaattccaacactgtttgatctgattctgcagttccaatgggggatgatatgtaaagagaaggggtaggactgcacctgaaatgttactagaattctattcaatgatctgtgatcctcatattcattcaaaacctatgggtgggagatgtggggaatgggtgggagatgtcagaatttgtatttacagtgaagcagggagtttaataaggtggaatttcaaggtttttaaaactcgatggtttttgtaaggtgggagtggaatggagagtgaggtagtaaattgggataatcaacctcggagtctctgggatgggagagatttctcctcagtattcaaattctggaaaccttttgaacttccaccaaaaataacaagccgtctaataaacaaaccatcccatgcacagagaaagaaatggatggttggggctttgaagccagtggtggttcttagtctgtgtggctaacccactagggacagatggtattattgggggcagctctcagaagatttgtaaaatatggtgaggttagtagcatggccaattttgttgtacagtatcctcagttaagcatgtataccaggagaaggatccatctttcttgcactttgaaggatttggtaacttattcaggacttggtcctatagctgtggcagcaacaagagtagtcagctcagcttaagcctctgttcctaaaggaacttggtctaaacttgtaggtctaaagacctacaagtggctctgatggggacctgcagtgatgcaccagcgagcgacaaatggagacatttctttaacaaggaaagcgatacaatttctacatgggaaggatgcattggaagcaacctggttagaagggggctggggactcattttgaaggtctggctgcacaacaggcatcatgttcttacttagatttaagtttctttggaattaataaaaattatgagcaaactgactcctttcctgaggtacaagtttgctctgcggctgctctttctcttctgtgaaaacgtgaagctccagttttggtgctagcaacaacaggacagaggcttactttgcaatatgtctgatagtgattgtgtggttttcctgcatcaaagggttaaagttgaaataaaacttgcatttcattttgagcaaataaagcaagagcaaatggcattgtcctgagaaatgttagcacactgtagattcttaaatttattgtggttgaggatggatgctctccagattagcaaggcagcacttccaatgttcagtggagggcactttaagatgcaattatttacacttcatgttgtgatattacaacaatagttaataagagctggagagatttcctaattatctgagggtgcaggaaatcatttcaccctccccttacttgaaatactaggaatcaagtctgcaggaagctggctgatcacaaatcacgtgtcagcacctccataacatttacctgcataatttgtccttattattttttatgttgatgaatctatattgataaatcttgcatttatctgttttttgcagtatgtatttcctatttcacagtagtagggaccctacgctctatttactttgtgctctttcacagtacaccataggatttaaataaatgcctattgaaaaattcaacaaataagccatgtcatttttgttaagcagctttacttggaagcaagacttctgttcaaaattatgctaagatgaagagtctcaccatcatttccctggtgacctgtgggcacagaatttaatgagaatttgtttccttgccctcatagcaacttcctctgcataagatcctaattaaccaccataaggtgatttaggccttggggtggggtggaattattcattttcctctattttacatttatattttacttcataatactgcattcacttcctttgaaatgttagtattaagaagttttctagtagctgttctcttaaaattacgaggatttttgattttatgttattttattagtcaaaaactaaaaccaaaagcaaaatctgtaaaattccttttttgaggatgtaaaattgccttatacattatatctcattatctttaccgattttaaaattaacacctaattaaaccgtgtgtgtatttcaaacgtgaggctaggttctcattgatgctctccactaaattgttgcatgaagctcaagaaaaatgtgaaagattatacagtttttgggcaacaaatattctccctaagactcaagatgtgttttcttaagaaaatagatttaaaatgtgaactatttccaaaatataaagcaaattaagaagcattttcttgaaggagaaaatgtaacaattaccatagaaatgcatttgccttgatatcgtcatttttagcaatgagtttgatcagctttgtgttgatgatcaattctaaaatgattctttcctatgaaaaaccatgctttggtttcatttcacagctgctaatttatttacttcacatttgttgtcattatcgcattctctgtttattcttgcttcaaatgtgttttgccccgacacatgttcaatagatacaatcctttacataaaaatgaaagtagatttctaaaactctgtagtatatttacatcaaactgtgggtaaaataatttggaataataaagtgttttagatattatggcagtgatgaagaaaatgtattgaaaatgatgactaggccaggcacagtggctcactcctataatcccagcactttgggaggctgagatgggcagattatttgaggtcacgagtttgagagcagtctggctaacatggtgaaatcctgtctctactaaaaaatacaaaaattacccaggcacagtggtgggcacctgtaatcccagctacttgggaggccgaggcagcagaatcacttgaacctgggaggcagaggctgcagtgagctgagattgcgccactgcagtccagcctgggtgacagagcgggaccccatctaaaaaaaataaaataaagtaaaataaaataaaataaaataaaataatgactagcttatgctctcagtacacattttggattagatttcctacttcagttaatacaggtttcttctttccctcaatattattgcacatgccataaatatatcttgcaaaactgaataagaattaactttgaggcagctatacatcttatagtcttgttagcatacagaaaacaattaataaagaatcttcggaattatttagatttgagttcaaatcctgagttcaattattaggagttaggtttaagaaataattcactctacctctcttccagtattcgagaatacagggttaaaggcagagctcaatcagatggcaaaatattggctttgtttacacttccccagtaattatgaatgttaaagggtgttgagtgggattttgtattttgttgtagctgttgttgctctcaaattggtaactagagttcacagctgcatgcagagattagcctggtataccatttactaaagagagaagcaaaaaattatggtcagaatcctgtctcaggagcttcttaagagttgaaagaaaaaactcaatttccccaaccatcaaccagctgctcggcttgtgcacaaaaagttttggaggcaggaaggaggagagtagctctttgaaatgttctagcattgtggaatgtgcatcatttatgatcagatgggattccttctatagcgcttttctcatctcaagtcaagtgaagggctccaacttaatcatttgtacagactggtgcacgtgaaagaaggagacttgcaaatgttccctgtttagttaactgaatcagtaatgaacttccgaatctgtttctgtgccaatgttgggcagataggagaaaaatggagagagatggtagggagggtcagtggagcacctacattctcgcctttcagcccaggtggggtacatgaatgttctgtagataaaaaagactctctctctctatatatatatatgagatggagttctgctcttgtggcccaggctggagtgcaatggtatgatcttggctcagtgcaacctctgcctcctgggttcaagcgattctcctgcctcagcctcccaagtagctgggattacaggcatgcgccactatgcccagctaattttatctttttagtagagatggggtttcaaccatgttggtcacgctggtctcaaacttctgacctcaagtgatccatctgccctggcctcccaaagtgcacggattacaaggatgagccaccacactcagccaaaacagacccagtattaagcagctgggcttgagctgttgctggtacctcatctaagggggttggtaacaggctacagtgacaaaagcagcaagaggcagtgagatctccaggaagctggaggaaggtgggatgaaggtggaagtacctgagacctgtgcagaacctgacccagtagaggggccaggctagaagagatgtgataattccaaggtgctaaagaggaagggggaatcaaaaaagagacaacgctcttttattttcatttcagctccttccagccatagttctggccagaaatggggggaagggggaaatattttgaatcaaactgagttttagtgacagaaggtgacttgagatttatggaagaatcaaatgcataaaggcatgggaaaggagaatttggcaaaaaatagtgtggaaaactgtgtttgaagaaaaaaaatggaaatatttcaggccaatgagggtctttgataaaccagttacagctggattagagaactctatgaggcttcacatgttatttttcctgaatttaaaccctgggactcaatattatttctaaccaatcataggtagcgaggttgaaagggagactacagagacctgattggtgtttttaccacctggacctggaagcactgtcattgacagatcccaggtgtaggcagaaagggcaggggatccgggtgcaaaagaatgagccttgccttgtttttgaagtttccgttgaaccaagctgatgagacatctacctgttgttctagttactgttagtgcataaaaaattacccaaaatttggtggccaaaaacaataatttattttgctcacgatattgtggattaagaatatagagagggcagttcttgctaaaagttttaaatgcaattgcagtcaagttgttagctggggctgcagttatatgaaggttcacctgggctggctgctcaccacagctttcccacatggctcgtagtggacgtctgctgccaactgggagctcagctggagctgtggacttgagggtgcacacatgtgtgacctctccatcacagcagtctcagggtagttgaacttcaggcatgactgctggctttttcagaaccaagaggaagtagaaagctttgtttgatcacaccttagaataattggttacaagtatatcattaagaccagcctgaattcaaggagagaggtataagcctcatctctcaatgggaagttgtcaaagagtttgtggacatgttttaaatctatcaccctgtgaaaagccaaaaatactgctccaatcaaaaaaaaattcttatattttggccaaagttccatttcctaaggattgtggggagggggaaggaaagtttttgtgaactcgggcaagtcattttaactcgctgattttcagttttctcttaccaaaatgaaagcaaaaatgcctactttattgtgctattgtttaatggggtgaggttggtggctcatgcctgtagttccaggtactcaggaggctgaggcaggaggactgcttgagcccagcagttggagactgcagtgagctgtgattacaccactgcactccagcctgggcaatagagtgagaccctgtctcaaaaaaatcattgcacttttgtaaatttaaatgaaaagacagtgtctaatatatagtagctcttattatttactcatattacatgaggtatccaaagagaatttctcgcaagatataatgaagaagatttgtatattggaagctttcatttatggttggagaaaaactgctaaagatttgtaattttgaatgaacattggcataaatagaaagccagcgcgcagagcagagaaggctgatatttttatgctaagctgtagaaatcaggaaatgtgtgataaggttatctgaaaaatagattcagagaaaccacagagagaggaaggggaaatcaaagtgaacattgatgaatgtgggtaaggatattgtgtgttggggaagcatcttagttcttccatttaatacacatgtgatgtttgaagcactcttatgaaaagtcatctttcatgttaagtggagatcatgtatttgtaacatttccatttggtagtcatatctctagctattaaaaatcacattgtgataaaatactcttttgataggtgctgactgtaaaatcatatggtagacattttctgcaatgtagcatgatttaatagaattgggaaaataatgtttttatatttctattataaataacattcatatagataatcttaccagttgctatcaatacagggaattcttgtttcaattaattagttaaaattttcattgtttttgtgctttactgtaatattgctactgttatttgaaacacattacatttgtataagcacatgtagcaatgccaaaaatattggggtgcctactctgtgcaggggtttacattagttgttgcatatttccaattcataattttgtgttttttgtattcctgtcattatggtatactttgttgtttttgcatagattttatagtctttttccaggttttaggtttggtaatagaaatacttctatctcatcaatttcaagtctactttcagaaatatttcaggaaggcaaactgcattcttaacaagagactatgttttcgttctttggaaatgggaagataattaagacccatattctgtcctcaggtagctaatagagtacactagtgtattagcctattagccatggcattttcaattgcaagaaatctaaggcaaaagggaattttagatcttacaattagaaataccgtagagttgttcacattatgaaaaataagttacaggattagggaagagcttatgttcaaatagttcaaagcagcaatggacgtattttgtattgaaaattccaaagatgatcataaagatgactccttggcacttgctcccaaatggattcatccttttattcattcagtctttcatccatccagtacttactgaactcccatatttgccaggcatttggtgctagagatagagaggtgaataagaccaagttttgcccttatgagagcaacagtctaatctagggagatgacagacagcaaaatcaatgaagagataatgaagggccacctagggatcattcctattaagctggtataagttggtttaaactagataatgaaagaaggtctttctgaagcggtgcctttgaacctgagatttgactgacatctctgcgaagatctgggaaagtcttcaggtggagggtagagcaggtgtaagaccctaggaaagtgggagcttggtagtatttcacaaacagtgaggaggtgggagtaaattcagcactttatgaagttttgtgcattcttcagtgttgttggcatcagtgagtgtgcgatagctagaaacaggtcaataaattattcatgatcaaaatgaatttgctgtttctctggccacattattgcacccttgggaagtggttagtttgccccacctggaccaaaggagagttccttacccaagaacctgaatcaatatgttttagtttagctatgtttttccacaagctcttaagctctttaattccataaagacaattatcactcctagacttaatcatttttctcttagcctctgtgttaccttctttaatcttattcaagacttgtttcctccagtcccttattgttttgccattaagccttatcaatatttgcttggagctatatttaatatattcacgttctttttctattctctctcattttttctgtgcaaggccaaatgtaaatgtcacgaaattatcagaatcttgaattttgatgtcacatttatgttttctatcataatgacttcttttaaagaataagggtatatatctcttatgaatgcttcttatttttaagttataatgtttctgccttttaaattagaggtggtaggatggtaatatgcctatgttaaatttgcttttctactagatgtgtttcctaactgctccaatctactcttgcctatactgtaatgttccatgctgtaaccagataattctttctgaaatacaaatttgaccacgccataattctgcctaaaatgtgttgatgatttcacattctttttgggtaaagatcagctccttacatggcctacaaagcctcaatgaaatagactcagcagcagggaggctcctctctgaccaaatcccttctcacttcaccagtttccattcactgaccttttcctccttagtttctgttctccatgccagtctgaaaacagagaatttgcatgtactcatttgtcgtgttcactacatttttttccctccttgactaactaacctatacatcctcccaaatctcaattcaatgatcacttcatgacagtcaccatctctggatagattgttaaaagcagatctagacagagtaccacatgcaatttctggtcaccctaaaacattatacatgcacacacagtgcatacacacatataccccacacacattccaggtaatattcagaaatcttactattttaataggaatgtgtttgcctaagttgaaccatgctcaaaaaaagaacattccaaattattaagctgactaaagctgtctttaaacagcagaatacatatacccactgttcagattagctaaatggggaaataactgcttttcaaggttattaacccacaatattctaatctcagatgctgtactagaacagtctggcacagttactgtttggtttatttttttactctagtgagctgtaggctgacacgttaccaatagcttcttttcattgtaagcagcatacagtgtgatgctcaaagtgtaaacaggataatttttaccattttcaggagcatctaagtcatctacagttggataacttttttccacaatttgtgaaatacaggtgtatctgtcaaaactgatgcacaattttctctgtttcttttatctgtataatgacttacccaattcctagtgtgcaagaaatattattgatgtcttattgaatcctgttgctttctgtatatactactgtgatcttggtggcatcttcatttattattctggtggacgcatgtagcttactatcagtgtttttatgagacaagaagcaatatctctcttttctaactaagcatttagacagtaaattctctttgcatggatagcagtgtggtcctactcaccactgcaacttcgttgcctagcatggcaccagcacacagttgaaacttcattcttgaaacagcctgtgggttagggatattctacctatttactagtgatgaaactgccccttaaaggaatgggtgagtgattgcccaagtgtacacagctgctaagtggtaggggtcaggctcttagtcgcagtgtggctcattatctagcatttgctaacatgttatggaggcattttgctactttaaaataatttatttattcaaacttcatattcactggtcagatttcccttgtcagactgagaaaagaaaccactcatttgcaggacagtagcaaacatcttacttgcattccagttgtgtatgggttcttttaaacttcataatattcttttcttattcctcttgctatatattgatggcaaccgtaggcctaggtttaccacatctctatagaacaaagccatatcttatgaattgttttaggtgctatctggactgacacagttttgttacctatagcaaaatatttactgctttgttgcagagaaagctagcagatggttttcatgacatcataggcagggaagagtagacatgtagggtccacatgtttggccttttttccaagagtctaacttcatatattcatgagaattttgaatgaagaattcaataaacttgttattgttctataatgagaaatctttatttgctgaaaacaaagcctattactgtgttctaaagaatagatctcagtctgaaaagaatgctagtgcaaagataaacttacataaaaaaactagtataaaatttaaatattattagcaatcatgattaaggatattattaattgtatatatatactatgtgccaaacaattggctaagtagtttatattttaccttatttaatccttaaaacccttttaacatatgaaaaaacttagaacttgaatgtttaagaaggtaatttttgttctaaaaactaataattagaagagttggggttaaagatatgttgaactctaaagtcgaaattattattgtttatattattcttttaaaaattaagataaatattatatattcattgtcatgattacttttataatatatttttccgacctgtctaaaatgctgtgaaggtaaagatcattatgtctgtttaattcaccactatattaaaagtattatattgcaccaccaatcatattgtatatgatttgtgtccattgtagatactcaataaaatatatcaaatgaatcaacttgagctttgaaggttgggattgtcacaacattaagagtgttataacctttcttctcagacatttttgaggagttggagataggaaactgcagagtttagcctgtttggaagaaagctggtgttttatagtttgcagcatgattggaatccagtgactcaactgcctttgaccatgaggtttcaataagaggcaagaagaacttcagttccaaggaaaatctcctgattaaaagagtcgtacactgatctcaaaaagacttcaatggcagcatggcatggagttcaagagtatgggctctggggctgggcacggtggctcacacctgtaatcccagcactttgggaggccgaggggggcggatcacgaggtcaggagattgagaccgtcctggctaacagggtgaaatcccttctctactaaaaatacaaaaaattagctgggcatgctggccggcacctgtagtcccagctactcaggaggctgaggcaggagaatagcgtgaacctggaagtcggaggttgcagagagccgagatcatgccactgcactccagcctgggtgaaagaggaagactccgtctcctaaaaaaaaaaaaaaaaaaaaaaaaaagagtatgggctccgggccagattatccgggttccattctaaagcactccacttattagctggtgacttttcaaatgacttctctatacccaaatgatctcatctgaaaattggagataatgattgtacctgcctcataggattattattattaagattaaatgaattactgataaaatacttagaacagtgcctgatacacaatatgtgttatgtagtgtttgttacatgagtattcattctaaaaagtcttttaaaatataaagtaaatgcttatagattttttttaaaaaattatgcatctgcttgaaaactaaaggatattatttgataaagtgctaagatgttctcagtgctagaattatataatagtagccacatcctggaaccataaaggcattcttaaggaagtttatatttaaaaaagcaaaataaagagccaggaatgagtaactagtgcacagactgtgaaaccagaggataatattctatatctgtaaatacacataacattaaaatccttaatttgacaactggcagaagaacacagcattgaatcttgtatattttcattttctctttctcttctctaccacattcatttccatgttacttttatccttttcagaatgaccaattgcttccgttttaaactatactcactgtacttgggatttatttctcttaccttatactggaaaaaaatgcaaaaaaagggcattcagaacttacgtgtcatttttatattgcgaattcaaggaaaataaatatttttgtgactttatttctaagtgttacatttgcttattttgtcttttccatatttccccctttccctgtctttggcatgacatttggaattgttattggaaagagaatcaactcagaaatcaggaaagttagccagtgacacattcctttattacatgatgcaaatattttgctttgctcttttaacatttttcttttccataacaagaagttttacagctacatttcacagattttacatctctgcatctaacagaaacataaaatgtagtttgcatttaggtatttgtattttattttactaggcaggaatgtggagtgtgtttgtgagcttgtgcatgtgagctggaaggaagtgtggttgcccagtacttcctcaactcatgactgaaactttgttccagttcaagaaggaaataaagagcccttcaaaatagaatactgaatactttcttcatccgctctatagaaatcaggccaggaagcaaattaaaattacaagaatatccaaaacagaattattttgcttgctgtctgtgtatttgaccactgccttttatgattttaacctttccagacattctctttggggtcggttttccttgtggcccataggagatcccactgaaatcatttactagttgttccagatttccccacaatccccattgcgctaagtggcggctaatgtgggagctgtcatgtttggaaaataccatgatgccatgagttaatttcatacctgtcacaagatcttgcatgcgatcccaggggaccagtggtatgtcacacactactgcaagcgttcgttagtacctctcaaagcaatgaaccatggccaagagatcttgttgcaacatatggcagcacctgtcaccaggcttcatgactggcataaaattaacctgttttcctgtttgatgcgctgcttttttttgcttatccgtaaaaaggatgagaataaattgtatttggaaacaatttactgttcctttcaagaagtataatggtagacttgggttactggacacaatgaatagacagtgtccttgtagaagtacacacactgctattcagtaaaggtggtattttatgaatttctgaatggcagtctgcacatctcacacaggaagcaacgttttagtttctgaactctgtcaaacttagacatagagcaagaaatgacattattgtgagccacattgtggaagaaaaatccaggaagcatgagtttcagatgtgagtttgcccttgcctttcgaatggtttcaagcaaccttgagcttcctctctcttctctctatatttctcacgctcagatcttagtattctaatggggacgcacgaaaaagggacccacagaaaaacaatattcagaatgatgccggatattcagtgtcttagaaaaatagattaatgggatttagtctttaagtcttaaaactgcaatttagcagttatttttatggataaagacaaagaatatagtccagcatttatatatggctttctacctcagagaaatagtaaaagttttttgatcaaatgatttctcaatagagaaagtatccggtttcttgcatcatttttcttttcttttcttttctattttggatcttcttatatatctttttgcagagccttaagcttcttaaaatatttattttaatcgaggggggagctgttttctatagctagtctttttccttcttcttaaggtaaatgcttcttagattctgtgagttttaaaattcatatacagcaaagaacaaagataaatttagcagtcttttccctttatgtcactaccaagtctagggaacaaatggtgctgttcttccacaatctggactggttgctttgaattctggagtaatcaatttttcctggcatttcttaaatggtcttttttattcactgaatctcctttgaaagtataaacattagtccttgttctatggttttggaaattgatgactgctattctcaaaggatagtatagttggaatgattgaaggagcagagcaaaaagctgaactgaaacaatggagggaggaaagatagtaccagagacaatgagagaagtgggcagtgattggaagggaatccgaagtagggattggggacttaaaggctgcttagacttgattaataaatgctgtataaatgaaatgctgagacaagggataaaattgcacttgagaagtcacttgaaaatgtgttaatgcctttacttgacaagcatttattttttcatcctgggtataaaaccactgtaggaaaatgtagatcattttttcacactgagtattttttaactgctgattatggttatgttgtcctaaaatcaggtttctattatctgaaaagaaaataaaaagaaataaatataggtgtgtaaagataagtattttggaggcatggatcttcaggtgaagtgtcatgtaatatctttgctaagtcgggataaaaataaaatttaaaactgaaattcatatttaaaaagttcttagtagagtctaggcatttttttttttttagtgtacctaacagtgatgaaaattttgtatctaaaagaatgagggattttgcaagggattttcaggagactgtggcactgtcatggatggtagctataccattttctaacaaagtatgtcaagaaaattgaacatcagtcttcttactagaaaagagaatctgtggcaaattattttattaataacagcaaactgaagagccacaaaataatttagataagaattaaagtgctgaataacttagataagaattaaagtgctgaataatttagataagaattaaagtgctgaaacaattttattactggtaaagctgaattcagaactgcttctggtaattttactgtatcaagcaggccctgagaaagacaacctggaactgtttaaagggagatgttcaacgatggtcacaagatgcaggactcaagagcttccaccattagaaactatcacctttactaccaccaacaaaatacctttttctctgagaaggagtcagtgaagggtagagatgaaataggaaaaatttggttggttgggtgggtagtaagtttaatcattactcttctttaatgagtaatagagtggaaataactttcctctctggttttaaaagttaactaatagtaagtgtctttgttaaaacacgtagacacacacatgcaccacacacacacacacatgcaccacacacacacacacacacacgcacacacaacaactgtttgctacaggatttctaattaatgatatcacattttctaacccagtaattcccaactggggttatttttttcccctaggggacatctgacaatgtctagatacattttttggtagtaatgacttgtattactggtttctcaagggtagagaccagtgattctcctaaattctcctacaacacccagcatatctcctcacaacaaggaattattcagttggaaatttcaagggccctcaggttgataagccctgtaattgcttgaagtaacttaatctccctagtaattgtgcagtatctcatagttattccttcttccactactactccccacaaatttgcccacaaacttgagaatttacataactccaggagtacaatagaaagggacctcacatccaagtgcttgggtactgtgctatcctctggttccttatttgccttcaccactatgatttactattggtaaagttgtggtcatgtcggttctcctggactaccagagcccagaaatcttctcttgttgatggttcacctctgtcttaaagtctactttgtctaatgttaatataactaccccagatttgttttatttttccaatttgtaccttttttttttttttttttgagacaaagtcccactctgtcgcccaggctggaatgcagtggcacaatctcagcttactgcaacctctgtctcctgggttcaagcgattctcatgcctcagccccccaaatagctgggattacaggcacatgccaccatgactggctaatttttgtatttttagtagagatggggtttcaccatgttggccaggctggtcatgaactcctggcctcaagtgatctgcttgccttggcctcccaaagtgctgggattacaggcgtgagccaccatgcccagcctatttctttttcctatatttttgcttttgctttgtaaatacctttgaatatacagtttatctcttctagatacgacataatcatatcatttcaaaaactattctgctaatccttactttttgttagtgtttaattcatttatgtcttatataattactgataaggtagaattgatgcctggtgtttctatgtctttgcttttttattccttcatatctgccttgtttttcattaaataaatattgtctggcatgccattttattaccttgtttcttttgttgtagctttaaaactattttcttagtatctgttctggggaatacaattagcattttactaaaataatctagatcagataaaaattaacttaatagtatacagaaactttgctctaatatgtacctgttacttctttcctccttggctgttattgtcatacaaattacttttatactgtgtaagcccattaacgtggtattataattcttgatttatgtagttgtcttttaatcggatagaagaaaagagttacaacaatattttaatactttcttttgtattttcctttactagtgttctttatttatttgtatagattgaggttaacatctagtgttctttcattttagcttgaaggatccttaacatttttggcagtgcaggactgctagtaagaaattatctcagtttctgtttatccaagaatgtcttattattatttttgtaattttcaaagaatagttttgctgtgtatagaattcttggttgactgtttgtgactggttgactgtctttctccttcagcacattgaatatgtcatcccactgaaaaatgtgaatggcttcacaaatttgcatgtcatctttgcccaaggaccatagtaaccttccctgtatcattcaagttttagatgggtcaccaaagcaagcactctggatctttccatactgcaatagaaatgaggaagacttgggggaacttactatttctctccatataaatcctgcctttgccactttttatctgttttctggactatactgtatagaatacagggtctttctaagaaaacaaaatactttgattttgtgtccagggatccaagtaaaagccctgcttttggggcatctggtggttttctaacagctcctgctctgattgtttccttgtattccagttttctgcctaatcacatgcagaaccattccattcacatagtgaatacatctctcacttgacacagggatcctcatttatgggaaagaaacacaaacctttcatttgaaaaagatattattatgtttgctttatgcagtacataaataaaacttgatgatcactttctcatagccattctcttcacgaatatcattagcattcaatgcagaaattagcctgcagtcttcccctaatgtttgcatgtatcttttttgtgatccaacattttgctattaaatagaatgaattatgtggagacatgattagataataccaagagtataagtttcctgagattagcaatcacacatggtttattttagtcctttgtagaatgttgtgactatctttctatttatgtacacatgtatctatgaagtacttattcatccatccttttattcattagtctagccagtcaactatctattcatctatctgtctgtctatctgtctctaacatatctttttcttcacaggaattcaatttgatgttagcatatgatagttgtctaataaatacatgttaaattaaattcatatgaggaatacagactctagtgtaaactattggcattactgaaatatgggcttgatcattcattgtgtgggtaactaccccatgggtacatacattggatgtttagaaccatcatccccggcatctcaatataagccagtattattctcccaattgtaacaaccaaaaatgtcttcagataacataaaaacatccgtgggggaaaaatccctctcctccaccccagttgagaacagctggtataaaagcatcctttccttcttttatcacagtatgtatgattaaaataaatgttaacaatgactaatagtagggaatttatcagatgaatgaatgcatttacatatgtattttccagatagtcacactctccctcactgattcatccacccatttattattcaacaaacacttactatgtaccaattatccactaagtactttgccaggtagaggggatacattcgtgaaatgtaagtttctgccctgatggggcttacagactttcggtggaactagataaaacaacgaaacaaaagatattactaataagtgttttgtttacaataaggcaggaagttataagggaaagacaggggggctgcatgagattagtggacaaggaaggactttctgaggtgacatttaaggtgagaaatgaataataagaggaaaacaaacaaagatgtgaaaaatttattcattaattttacttatttcttatagcatatgaggtttatgctaggagtgcaaaaggatgatcatttggtggcatatcaacttgcttctctacccatatttgtgaaaaacaccagattgtttgtgtggaagccactgggaactgttccaaaccgtgtgagaagtctgacgttttttattgagggagcatagccctaccaatgtaaaggcgttgttttatgacaatgccgtgaaaactggtaagacattgaaaagcaaaaatgagacatgcagaccttaaaatatcctgtgtgataagaactagtgattgttcactgaaaaagacaaattttagttctatcttcatgacattatatgttgctggggagatggtggtgaccagggaaaactgttcagaggaaaatcctggcctgatacatttaaaagaaagcaggtaaatgcgtattcatctttttttttttttctccaacctcagtagatctaaggacattaatcagaccttgggataattatatatagctgtgctatgagtacgtggattcatttataattccattggtagtagataatgcaattaagtacaaaattctgcagaatctattatatcgttgtttgacgaatcaaataatgtattctgcatttttattctcatgaatatttcccttataaatagatgtctaaaatgaactattttgcatatgcttgccttatgaaagtaggcttatccactggaaatacaaagctgttttaagcatatttgtgtgtttaaacatgcttacgcatgttttcaagcataattgaaataattagaataagtttcattatcacctttcaccttttatgctagatgctggatcaagtcaaaactggaattgcaagtcaaacatcttgatgagatacagaattctgtaaagggaagagatgaattacaaaatacaaccttgtttgaggaagacattatgacagctgggtgacttgggcatttaaatggaatctgatgaagtccctcccaccattttctctataaaatgccaatggcatttaaaagtagtgtcaccagaggagccaatgtatatttttatactgcaattaagcaattgagtacaaaattcagtacagtcagtgggaatgtgatcagatgaataaaggaagtcagagaagataatcatttcagttctttccctaattttgctttctagcctggtacttaaaattcacaggctcacaagtctcactgggctccagagaagaagcctgactcctccccagctgtgtactctcaggcaaactacgtagactctacctcagtttactcaattttaaaattgagatcataattcttgtcttctagaatatttgtgaggattgaatgaaatactatgtataatatgcacattacatagctaatgctcaataaatcataactttatgattagcaatgtttgtttccctcagaagtgacctaaaaccaacaacaacaatatttttattttgctttctatgatcactgctaattatgaaaaaaaaaatgtgcctgccttgatgcttaggaaagaaaaatggttgcaatgagagagaaagcagtgtttccagacttgtgatgactttattcagttttctgcattttgtttctctctggcagttttttttctcctgtcactttcaagattgaacataattacagtaatgaattataaatgaacataatatgtaatgaatataatacataaagtttattacccccattttcataattctgattccaagttagagatccccttccaagataggctccatagcctcctgtgtaagatgtctctgcccaccctaccccagataacaccacccagtttgtctcctgcaaggcacttatcacaacccttaatgttttttgttattcgcagggggtcctgatccatgccccaaaagtgggttcttggatctcgcacaagaaagaatttggggcaagtccatagagtaaagtgaaagcaagtttattaagaaagtagggctgggcatggtggctcatgcctgtaatcccagcactttgggaggccgaagtgagtggatcacctgaggtcaggagatcaagaccagcctggccaacatggtgaaaccccatctctactaaaaatacaaaaattagccaggcatggtgacgcacccctgtaatcccagctacttgggaggctgaggcaggagaaccacttgaacttagtaggcgtaggttgcagtgagccgagattgcgccattgcactccagcctgggtgacagagtgagactttgtctcaaaaaaaaaaaaaaaaaattaaacaaagaaagtaaaggaataaaagaatggctactctatagacagaacagaagcatgagctacccagttgcttatacttattgttacttattgattaatgctaaacaaggggtggattattcatgattttccaggaaagcggtaggcaattcccagaactgagggttctttccctttttagaccatataaggtaactttctgacgttgccatggcatttgtaaactgtcatggcactggtgggagtgtcttttagcgtgctaattagaatataatgagcagtgaggaccaccagaggtcactttcattaccattttggttttggtgggatttggccagcttcttcaccgccacctgttttatcagcaaggtctttatgacctgtatcttgtgccaacctcctatctcatcctctgacttagaatacccatccttctgggaatgcagcccagtaggtctcagccttattttacctaacccccattcaagatggagttgctctggttcaaacgcctctgacattttcatttatacttttcacatatgtatcaacatataatataaaaatttaaaatgtcatatattatatattaatacatattatatttaccatcattagaatgtaaattctagtaggtcagtgaagaaatctgtcttgttcaccactccctctctagacaatagctctgtgccaggtacatgcagacactcaatgtatattgaatgttgaagaacttttcctgcaaaccgtaattgccacctgataggtttacacattcgattgtcttttcacctgctcttatataaatttgtgctgagacacgcaagccatttgatgttgtagttattttttacagtagaggtgctttgggaaagatgattgagatacctccttataatcttagaatccatcctaaaatgtcttctactcagataataaatgccagtctttgatttgatatatttaactctttaggtaatatttacaatacatagaactaactggatttagtaagatgctttaatttactgatagcatgctacttattagtgtgtgccttcaagcatcaaatataccaaaaaaatgatcatttttgttatggtagcagatagatacattgctccactggtgtctttttttgtttttttttttgagatggagtctcactctatcatccagggtggagtgcagtggcacgatctcagttcactgcaacctccgcctcccgggttgaagcgattctcctgcctcagcctcccgagtagctgggactacaggcgtgcgccatcacgccaggctaagttttttgtatttttagtagagatggggttttaccctgttggccaggctggtctcaaactcctgacctcgggcaatctgcccaccttagcctcccaaagtgctgggattacaggcatgagccactatgacccgccttcactggaattctttagctagccttattttacttggattctgattgaaatatgttctcctcagaatacaggatgaaacaaagctaatttaaggtgaccaagtttatacattaagtacaattagtgcatttttcaccagaaagttggtcactactttaagattttaccttcattttcattagaaggtattggttaatctattatctcctctctctaactgcagtcatcatattaaacttttgcaaattttaggtgacaaacacatgtcgaatttacatatatacaggcataatttacatatatgcatatacaatgtacaatatatccagaaggtaattagcaactggttacagtttgctactaatgtacaatatatccagaaggtaattagcaactggttacagtttgctactaatgaggtcaagtttacagatctactgttcctctgagtctgtcttttggctctgttgcattgccacagatcctatcatgatccctgggctgctgtttcacacacgttgtttgtcacaggaggggggccatgaaggaggatgtgattgctcccctgccaaccccctacctctactggtcaaggatctcagcatttttctgacgaatggcatgggcgggatgcgctccatctttgcattctctatgtgtcaggctgtgtccacagggaattgtctgtgaagggtttttaaatcagtgggaccagtaacaccatctttatatagtgaagacagcttatcattaaatatagtttgagacaagcttaattgtgcaactgaaaaatattttcgataatatttacaacttttatctatttagtgttattagatgaagactttatcatttttttccatcatgcctttggttttgtgagcttcttttttgtttttatttcccgatttctttctttcagatacttttaatcaacatttcttcctttggaaaacaggtcaaatgacaatgcgaagggtgatcaaggagaaaatgtgtgaagtagaagcctagaactcaagagaaatgaataatatcttggcatcacttactttgctttaatttcttagttttactcctttaatgtaacaactgtttttcatttaaaagggagtcatgaaacaaacatctatataatattttggggattaaaaatgcatttgcaaagttagatttattggtttttatcttaaagacataaaaacttgatatcatatttaattttgtgctcaaacttaccgataacacattacttaatccttgaaattatttgctttattccctgttgtggattaagatgagtgattttattctgaaaatattaggttgttgtaaaagtaattgtggtttttgccattaataattcacaatatgagagcaattatagaatctagctaaaattatatgtatttatccatctctcattattcatggtagttatcttctataaagtctctgcaaacactgaattagtaaatactgaacaattactcctggtaggtaaataagagcttggttcctgcacgactctggccacatttttgtcaatctatcaatacataatcttattttatatgtatttctgtttaatgatatcttatgtaatacatattgtatgctcattaatacatttatttaatacatattgatttaatacatatcttatttaatacatattttatgctcattaatacatttatttaatacatattgatttaatacatcttatttaatacatattgtatgctcattaatacatttacttaatacatattgatgctcatgtgctttcgagcatcaaatataccaaaaaaatgatcatttttgttatggtagcacatagatacattgctccactggtatctttttttttttttttttttttgagatggagtctcactctatcacccagggtggagtgcagtatactcacagtatactcatagccaatagcaccgtaactcacccctcattgaagcttgttcaacacagtttttttctctgtaaggcatgttatagcctccttgtgcttaagaaaactagggagcacttctgcattatttttaaacagcaagtcattttaaacagcagaatcataaacaaaaaacataaaaatgagaagaactaaatagaccatgaaaaaaccacttgtttatagtaagagaactgaaacatgaaggcagagtttcactttgttcaacctcagctggcaacatgtgtagggggtaactcaaattttgtgattctctgcacatgttggggaaagatcacacaaatattgtgagtattaatttggagtacaaattaatattagcaaatagctgtatttgcaaatatggaatctgtggataatgagaacagacagtatttatattctaggttagaaaagagaaaatgagctccttttagtcatcagaagccaatgaaagacctgggtttagtattttcttccatctcttgatttctgtttgcttaattgaatgacaaattctaattagtcatgcctgactaacataatttaggatgaaactatgtcttcatcactctctacttctgaccctggccctgttcctagagtacagtaggcattcagttaatgcttgttgaaagaatgcataaacccctttcctcatttggaactttatggaattgctgagaacatcagatggcaataaggtgattggagctgtaatcacacacaaaaagttgtctattttaattagccaggtgtggtggcacacacctgtaatcccagctacttgggaggctgaggcaggagaattgcttgaacccgggagacagaggttgtggtgagcagagaatgtaccactgcactccagcttgggcaatagaatgagactctgtctcaaaaaaaaaaaaaagaaagaaagaaaaagaaaaaaagttaaaaccaccaaattgtttattttctattttgaggattttaattttgcttaataacatagtcattgaaattaatttataaataatattgtatagttcaaaacattaatataggacttttttgctgtaaaccagggttgcctgtttaatatttgtatttcattatgagtagtgaactagtatctcttgtaatgcaaggtaaagaggaagaggttggttaacaaaaaggaactatgttaattttgctattaataagggggaaaaccttttgaatttatttatcctggagacacaaaacttaaactcataatgatgtcatatatattagcattactatatttccttattattgcaaatgtattctacccaggtcttttcatcattgtagtcacttaaaaaacatattgggtaagttttattatacaatttttctcagattgattttagttttattttttcttttctcttcttttcttttctttttctttttcttttttttaacctcagaaggaattagatgtccagtataaagaagcctgatcactctggccttacttggctttccaataatagtatttttaggatcactgatataaaacctacaaagtaagtaatttggttcatataagcaggcaagtaataaattttcctatacattgttatttctcattaaatacatactattactctccaaataagagatttttagaggtcattttttttctcatttttttaaaatactgactgacccatatttgcactggtagactcagaagtgtttggtttatacttgttcaaaatgattgtcagcagatgtaatgagccttggaccagtccagtaacttggctaacatatgtctgcagaaggattttaaaatcctgctgactaggctggtcctgtcgagtctcacagcagaaaaattgtcttttgcagctcagcttataaatataacctttgtgtgtttggaaatatcccttctaaggcaggacttatgctcaccctgaaattcaaatgttcattttgatgtcagcactaaccaggagaaagaaaaggtggaaacgattcctcttgcacgtttcagagtgttagaaaccgcctattatttgtgtcttgttctttgctgctctgtacaagctctagaagtcataaaagtgttcctcacaaattgactccttagaaatgctgactctgtgtttcaaatcttataaaaatatctaaatggtagacgtattgttttcattacagatgcattaagtcaaaactgccaaaggctgtgttgtttctgcaaacagggcaactactgcttgaatggggctaatctgtttaggcactgaggggctagctgtgctgtctgcacatatttaatcacaaagctttacttgactttcccacatatttccttttagtatttttacttatggaaagcaagaatcaggttttatagtcattcagtaagtcctctttttaaataaaaattgttatattggaaacagtgtctacaagaccactggtggaaattaatatagccaatataattagtaagttggattcaccacaccacagtaggtaaatcttattgggggcaaaaattgctatcttattcacaagtgtgttgagctgttcttgtattgctataaaggaatacccgagacttagtaatttataaagaaaagaggttagttggctcatggttctgcagtctacaaccatggcaccgctcagcttctggggaagccacagggagcttttactcatggtggaaggtgaagcggaagcaggcacgtcacatggccagagcaggagcaagagggagagagtgggggaggcgccacacgcttctaaacaaccagatctcaagagaactcactatcatggacagcacccagccatgagggatctacccgcatcacccagatacctcctaccaggcaccacctccaaaatcagggagtacgtttcaacaggagatgtggttgagacagatatccaagctgtatcaccaagtgaactaccgaagctttttattgatttgtattaagccaacacatgggtttacccagtaactcatgatttttacacaaaaaccaaattaatgtttatcgaacagttatttggatataaatacatagatatagcacagtgcttcaggttagtttataaaaatcaagtctttcctttaaataataaatgatttatgcattcattcaaatttagaatgctgaggaataaactacaaaaaaaacttgtggctgagtgcagcggctcatgcttgtaatcctagcactttgggaggccgaggtggatggttctcttgaggccaggagtttgagaccagccttgccaacatggggaaaacttgtctctactaaaaatacaaaaaattagccgggcatgatggcaggtgcctgtagtcccagctactctggaggctgtagcacaagaatcgcttcaaccggggaggtgaaggttgcagtgggctgagagatcgagccactgcactccagcctgggccacagagtgacactccatcaaaaaaaattttaaaaaaaccctaattgaatctttccccctgtatttctgagaaaaaggagcaaatataaaataaacaaaaagaatacatatggaacatttatttagaaatcaaagacccagcgtcatacgttctaatgtttgataagatactacccagtttcctgcaactttcacttttgttctgtcaaagattccaaatgatgattgtgagccactgtaacctgaagacatattggatacatttacttatgtgtgttaaattgtgattcttaatgctattttgtggaaaggctggagaagattttttttttttttttgagatggagtcttgctctgtcactcagcctctggggttcaagcaattctcctgcctcagcctcctgagtagctgggattacaggcagttgccaccacacccagctaatttttgaatttttttgtagagacaggcttcactgtgttggccaggttaatctcaaactcctgacttcaggtgacccatccaccttagatttttaaaataaaggttacaggctgggagcagtggctcacacctgtgttctaagcactttgggaggccgaggcaggcagatcggttgagcctaggagttcaagaccagactgggcaacatgacgaaaccctgtctctatacaaaattcaaaaattagctgggtgtggtggcaggcacctgcagtctcggctactcaggagggtgaggttggagaatcacttgagcctgggaggtcgaggatgcagtgagtcatgattacaccactgctctccagtctgggtgacagagcaagactcttgtctcaaaataaataggtacgtacatacctacatacgtactagaatcaagggggttgtttctgagttcattgagttaacgaggaaggtaaattaatcaggaccttcccaagttacccatgtaatattatttaattgtacatgtttaaacaagctcagattacgttgactgtgagtcttaaaacggtaaccacaaacaggttataccaagatccctcacaatgtgtgttgtctgagagaaaaatcttatcattttctttttttccacattcactattgttcctagattatgaaaggtagtcattcactaaacccttctaaaatattccttttttttccaaatatagaattattatattagtaacagtacaggcatgcccataacaaaaaatggaaactaatatagtcaatataattagtaagtttgattcatcacatcccagggtagaatacctcttgaccttcaaaactgcggtcgaccacaattcagattttgagctattcaccagtgagaatgcatggcaatacatgcctaattggcatagttacatgtcattaatttattccttttattcatttaacaaatatttattgaatgtttactatgtgccagacactataatgctgttctaagatagcttatattacttattattgaaattatacttattaaaatggtaataatttgtagagagattaaactttgttttcttgccctccctttctccttctcctcttcctttcttcctttgtttcttttctttctttgcctccttcttttgtgtagccataaacaggagtctactgggtcgtttctgtttgtaaggcacaatctgcctcccaatccccctcccaaaaaaactaacaaaatttagggaaggagctgatttcacatttcttcagagggcctgttagagtgataaaaggcaaaattattttctttacacgaacagtcacagaaccaaaaaggccaaggaagaagccagagagcacatagtatttaattaggagagtttctagtgtcccgaagccacagaagaagcagctgcttaaacattgcttaccctttgactaatggccaaaagcactgaataggagaaggattaacatggataagacttaaataaaagtgatacaatcatcagagcaacaacaaacaaaggcacattaaaaagtaacatgaaatgatgttaagaaagaggtcatggatgcaaaatgataaaatgtttcgttctttggaagtaactctttttttttcttctgttcttagtcatccatctctgtcagagttctcaaataaaaatgcaaaggaaagttagcaccactctaaaacagtgaagggtcagttctctgcttttggatatgtaatttgaatgggaagtgtcctaatgacaattaaacacaattttctaagcacaggaagaggactgataaagtcaagcaatggctgtggcttttcttttgtacttccgttactattaactatatgcaagttaacaaatgctggacagcctgtccagtgagcagggttgctccgttgccaggcttatgttttaagcgacgattgagtgtacacagatctaaacaatcatgtgcaaagtctaagtctctcattttgaattcggaagagagaaccttggtgccccttcttcctgaggaaatttgggaactatagtacaactccctctcaaaaaaaaaatactcctgtaattccatcctaactactgattgctttatatttttgatgtggtgaggagttcagaccccttcttagtgaatgcaatgtttagcacattctttggaatatactgcttgagtctcttggtgcatcagctgaaacttcattttaatatcccgtacgcacttagtagatacttgcctttcctctacattggtgattattcctggcctatcattcagttaagacctatcctccatatacagatttttatatcgttcatcgaaattaagacttgttgcaagtaataaaaactgaactcaagctacctaatacaaatggaatttactattttatataccaaaattctgtgaaaatacaggtgggactggccttagggatacctgatattaggatataaatcctgtcgcctttctctcatgcttttttttcttccctttgtaatcacttctttattatttgtcactgacctcttcatgaatttagaaccacggtcgtcggcactttctaactcatgctttcatagtttcatgaccacagaggaaaagaggctttggaaattctcaaggaatcactgtgactatccacacttgggtcacattttggactcattgcagcagcctgaaggttagatggtatggatgccccagcttaggtcatgagcctgcacttgggaaaaatgaggggaagttatttttaaaatggaaagaagtggaaggcagacattgtatccagttttatatatttatataaacaaaacactgtaagggggaaaatatagacttgaatcagaggagaagagttaaaccaatgtttatatatttctttaggtttgttggaatatatgtgcatgtaattatatcagcaaactacatagtgaagtcagggagacagattagagagataggaagagtgggagggagagaatgtgcaaaacaagcaacagaaagaagagtggggacatcctgagtttgtatgtgaggagaggacagataggagaggtacaaaggaaagggattagaacagagaattagttagaggatggggagataatacaagggagagatagccaggcatggtggtgcgcacctgtagtcccagctgctcgggaggcagaggtgggaggattgcttgagtcggggagatggaggcttcagagagctgtgatcacactactacacttcaacctgtgtgacaaagtgagacctcgtcttaagaaaataaataaaataaaataaatataagggataagtagagagatcatgagagaaaggaacatagagggacacagatgcaagaacagggaaagagaaggggtcagaaaagcgtaatttgtggagagaaaattaaaatgctattattattggtattattgctgcagttgctctcttttgcccattagactattttggcattattggcaggtttaatgtaaaatgagatttgtgagtaacattgatctccaaattataaatgtctttcaataggatatgaacaaatatcatagtaattctcaaagaatattgctatttttaatcaatggagtatacaacatattatattttaaaatcatacaatacttcaaacaccgtgaagagagaacaaagccatatcaaataatgaatgaatggttgtattacggaagtacttgtcctgatagaacacttcaaataccatttggctgctacttctctctgggtttgctttgtatcccatggagatgatctgagcttaagcttttgttagcttcaaagagagctccgttcttgcctcatctctgcagtattgaaaaaacagacccttggttaacaacaggaagccaaactgattttaatattgtgaactctttaccctgatgcaggaaatgttatctgggccatctcagtgggctggggattatagagctggataaggcttcaaaatacaaatgaactccataggtctggtacagctgtaaggtacaggggtagagaatattaggtggtcatcttgataatcatttgtgttatgttaatgcactccaaagtggacttgtttcttctacctgagtgtatatacaaccagtcttttcactattttcagtggttataactcaggaaagagacaacatatcaacatatgaatgtgggtatatccaacgagatctctcttataattttagtccataaataggcataaaaaatgtgttctttcagaaaacacttactggaacctgagataatacaataagtcgaattgctaaaaagagaccccatggatcacaggtctgacctaatatctagttttactaataattttaatggtataggtaatcacatggcatgggtgagccagggagagaggtctttgaccttcagtatagctcgcaaatgctttctttccacataagagcatgcactggacccacaggaaatctctaggtgacatgtgcagtttacattccttgctcaataggagtatttaggtaattaaaatctccatttatattcagatacttgcatagctttttccaggagaccatgcccataaatgcatagatttcaggtttgtttatcataagcagtgctagatagtgagcatttgatagatagggactgtctctaaatgccattaacttgcttgccaggagggtctctcattcatgagtcaaatctcatgtttaataggagatttgactgggctaccttgtttatttccagggagtggtcccttggtgaaaagagagaatgagtggtagacctattatttgaccatattcctcctaaataccttcttggtgatatggatacagagattagcaaaacagtcactgccttcaaatttttttaccatataagatgatgaacacaaaatcaacaccagagataatgtgcctaaacccttaaataacttgtgtgacacagaacaagtatctcaatagacagtaatattttttacgatagtattaacaatgccgtgttaaggtgctataacctggttgaatcttatttggatggtggagtcttagtggacaatggaatttgtacaagttttgagtatacttattctgctgacatttattgagtaacctcccatgtgccagacattatctgacgtgaaatgaaagagaattcctggtttccgtgagtttttagtcttagagaagacacagtcacgtaaataaataattgaaaaatatcataaagtgtttataaaaatctacttgttaagtatgagagtgcagcatacttggcctccagaaatgcagaaagtttcatcaatatacaaattaaatcttgaaggatgagtgaacacttactgggtaaataacaagatgaaagactttaggggaagagaatgagatgggctaagttagcagcatcagtgaacatatggacatgggggtgctgcagattcttaccattggttcccttttggatgttgatctaggaaaatgctggaaaattaggtttgcctcagatgatatattaggccaacaggaatgaatgataataaaaatagctaccaattttgagaaattactatgttccaggtacaatattaggtacacatttttaatattcatgacagattaggaggatgtaacatcttgattttataaataagaatttagttcagcagctagttagatactatgttgggatgtgcctccataactctcttactgcaaacccatccctctccatgaccctgtgtgagctcccctaggcttcgaagcttgcacattgttctcacctgacaggggagcagtgaaacaacactaggaggacaattagtcatcattcagagtgtatatcagtgtgcctctgcgaacacccacaggaaaaaataaatctacgaatagtgagattgctttggaaatacaatatcaaaacaaggtcactgctaccttctctctccattccatcgagattgcagctcctggcacctcttcaacaggaagttgttggccgcctctcccttgaaggttttagtaggagaatgaaaggatcagtattgggtttcagaaagataaattgcttaccaattgatggaaaatggcagcttagagaatctgtggttagagaaaattgtttgaaacttactataatatttcagagatgaagtaataagaagaatctggagtggcaaacatagatcaattgattgaaactaaaactaataagacttgctgtgaccattgaggggacccaagatatcagtttgaatcactacagtgagcagtgaggctacttagatagaaattgccagaaaaagaaaataaatgaacctttggatttactgagtttgtgggggctgaatgctaaagttttttgtttgagttgggggtagcttataggcaggcaggaactggctctgatgcaaacagaggtgatgggatagaagacatggatttgggttctgatgactttgtgagagtgaatgggaaagcacattcaatggcaagaaccttacaaggaggtagggcacaatgtggttaagctataatttttactatatttcttcatttttattggcatccaattattttatatgtactcactatttatttaaacagctttattcatggggtgcctattctgtgcaaggcaatacctttggcaatgacgacatgatgatgagcaaagcctgaatgtttcttactctcctgagtttattgtctagtaagagacaagcatcataagacattacactagtgaatgtataatttgaaactgagataagtgctctcgtgtgaaacatcttatttctaggaaaaaaaaaagtgcaacaaaaaaaagagaaaacccttgtgatatgaaaggtttccgaagaaagtgcagctgtgttaagacctgaaggataagagttgccatctaggcaaaaggtgatgaaagtaaaggattctccagactgatggaaaagttataacaagagattggagtgtttaggaagttaaaagaacatgtaattgaagctcaggagggggaagagagatgagagatgtgtgtagagtccagagcactcagaatttgcagaataataaggattttgatccatgttctgagtaatgacatgccattgaaggtttccattttttaaaaatattaacccagatctcctttacatgagcaatacagataggaagtgctgaggaatcaaagtagaggtagaagggattcagaccccagagtgtctacattaggagggagctgaacctcatcaagttctttccataggattttcttcatgcacaaatatgcatggctggcttagtctgcagaccacatttttggttcacctagtgtttcagatggcagatgacataactctgagtaaattagaagttctggctgtaccaaaaatatatacatcaggaaaatgaaaaaggaaactgttctgtgctgcttaagagaattcattgccaacctcctactggctgttctgacccaataaacaagcaaaagtgacttgttagagccagcagctatattttgagtaccattatccccactgaataattcaacacttaatggtggtgattttggttgctcagagaaggtattcttttgcaattgtgtagctctttgttgagattcagcattgtctagttaacagtatgagaagcaaagcagaattcttgctgtgaaaatcactacttctaaagagatgcggcattgccatatagtagttacattgtgcaattactacatggaaattacttgctgtcttgtagtctttttccggaaagaagacactcttttttattattattatactttaagttctgggttacatgtacagaacatgcagttttgatatataggaatacacatgccgtggtggtttgctgcacccatcaacccatcacctacattagctatttctcctaatggtatccctccccagcaccgcaccgccaacaggccctggtgtgtgatgttcccctccctttatccatgtgttctccttgttcaactcccacttatgcgtgagaatatgtggtgcatggttttctgatcttgtgatagcttgctgagaatgatggtttccagctttatccatgtccctgcaaaggacaagaactcatcctttttatggttgcatagtattccatggtgtatatgtgccacattttcttaatccagtctatcactgatggacatttgggttggttccaagtctttgctattgtgaattgtgccacaataaacatacatgtgcatgtgtctatcgtagaatgatttataattctttgggtatatgcccagtaatgggattgctgggtcaaatggtatttctagttctgcatccttaaggaattgccacactgtcttccacaatggttgaactaatttacactcccaccaacagtgtaaaagcattcctatttttccacaaactctccagcatctgttgtttcctgactttttaaagatggcaattctaactggcatgagatggcatctcattgtggttttgatttgcatttctctaatgaccagtgatgatgagcattttttcatatgtctgttggctgcataaatgtcttcttttgagaaatgtctgttcatatcctttgcccatttgttgatcaggttgtttctttttttcttgtaaatttgtttaagttctttgtagattctggataggtcttcgtcagatggataaattgcaaaaattttctcccaatctgtaggttgcctgttcactctgatgatagtttcttttgctgtgaagaagctctttagtttaattagatcccatttgtcagtgttggcttttgttgccattgcttttagtgttttagacatgaattctttgcccatacctatgttctgaatggtattgcccaggttttcttctagagtttttatggtctaggtcttacgtttaagtctttgacctatcttgagttgatttttgtgtaaggtgtaaggaaggggtccagtttcagttttctgcatatggctaccagttttaccaacaccatttattaaatagggaatctttttcccattgctagtgtgtgtcaggtttgtcaaaaatcagttggttgtagctgcgtggtgttatttctgaggcctccattctgttccactggtctatatatctgttttggtaccagtaccatgctgttttggttactgtagacttgtagtgtagtttgaagttaggtagcgtgatgcctctagctttgttcttcttgcccaggattgttttggatatgcaggctcttttttggttccatatgaagtttaaagtaatttttttccaattctgtgaagaaagtcactggtagcttgatggggatagcattgaatctatacattattttgagcagtatggccattttcacaatattgattcttcctatccatgagcatggaatgcttttctatttgtgtcttctcttgtttccttgagcagtggtttgtagttcttgaagaggcccttcacatcccttgtaagttgtattcctaggcattttattatctcagtagcaattgtgaatgggagttcactcatgatttggctctctgtttgttattggtggataggaatgcttgtgatttttgcacgttgattttgtatcctgaggctttgctgaagttgcttatcagcttaaggagattttgggctgagaagatggggttttctaattatacaatcatgtcaactccaaacagagacaatttgacttcctatttgaatacactttatttctttctcttgcctgattgccctggccggaacttccaatactatgttgaataggagtggtgagagagggcatccttgtcttgtgctggttttcaaagggaatgcttccagtttttgcccattcagtatgatattggttgtgggtttgccataaatagctcttattattttgagatgtgttccattgatacctagtttattgagagattttagcatgaaggggtgttatattttatcaaaggccttttctgtatctattgagataatcatgtggcttttgtcattggttctgtttgtgtgatggattgcatgtattgatttgcatatgttgaaccagccttgcatcccaggtacgaagccaacttcgtacctggtggtaagctttttgatgtgctgctttttgatgtgctgctggattccatttgctagtattttattgaggattttcacatcaatgttcatcagggatattggcctgaatttttgttgttgttgttgtgtttctgccaggttttggtatcaggatgatgctggcctcataaaatgagttagggaggattccctcttttcctgttgtttggaatagtttcagaaggaatggtaccagctcttctttgtacctctggtagaatacggctgtgaatccatctggtcctgggctttattggctggtagattattgattacttcctcgatttcagaacttgttattgttttattcggggatttgacttcttcctggcttagacttgggagggtgtatgtgtccaggaatttatccatttcttctagattttctagtttatttgcatagaggtgtttatagtatcctctgatggtagtttgtatttctgtgggattggtggtgatatcccctttatcattttttactgcatctatttgattcttctctcttttcttctttattagtctggctagcggtctaactattttgttgagtttttcaataaaccagctcctggtttcattgattttttgaagggtttttcgtgtctctatctccttcagttctgctctgatcttagctatttcatgtcttttgctagcttttgaatttgtttgctgtttcttctctagttcttttaattgtgatgttagggtgtcaattttagatctttcctgctttctcttgtgggcatttagtgctataaatttccctctaaacactgctttaaatggaaagaagacactccttaaatgacttggtgggagcttttattttatcaatttctctctgataaattatactggtagtcatatctggtcacggataaactttatttcgtttttgactgtcaggcatgttgaattcaaattgcatgccaaaccataacatttaggaaaacatcatatctctagagttataattgatttgtgctaatgatatgttagtagaaaagaatgacagtttgatttctttcattcaaaggaaaatctctacagtaaggaagaaagtatcatggctaaaagtcacttttatttaatctcaggttttatcaaaatatttacagaacactttgtctttgtcacctgctagtcattcagtatatttcaatgacgacagtattatctttggaatcacaaaaatatgatgtaaaagaaaacttttctagagtagagtgaatgcttaaaaatataatatatatccaataaatgaattacagttaggaatgttgacatgattaagaacgcttgcattactgatagtgacctctgccctattataactttatagctaaaaagtttaagatctttcacagtttctccttcagtaatcctttttccaaactgaatttcgagtgcctagtaacttgtgatttttctaggaaaaacccatggtctttacctgtttgttctatagataacaccctataacttgcttttttcacttaacaaaaaataatagatatatcatttatataacagatataaggcatactatacattatatataatataaatgtacatataaataaaaataaatataaatgtctggaagtgttcatatcttaaatgttttctggcagggatggggagaagagggttgtataatcttcaaatttttactgaatacgttcctttgccattattttctgttacaataagaatatattttattgtaaaataagtaaaaacaaattaattaaaaatggtacgtgatgataaaaacagtagttcttagaaatattatcaatattggaatcaaaacacataagactattaaacatgtgtatttaagtaaactgcacattatatccagaaaattgaatctaactggttatcatgcaaatgaagaaggtaatcagttcaaaaatgacatagtaactgatattgccttcctgttcttatttcttattcatggaaaacgaggacaagatatgaagggtttagggatctaggtcattggcccgggatttggcattaattcttctcatacaagcacagggaacgatcaatcagtgttgacagctctaatgccatcgttggagcagaagatgagccaaaggaaattatgagtttcttataaatgtgtcttaagtatctggaaatcatactttgtatcttatggcttgaatagaatacgtttgcttttaatgatttgtacagtgagaagattaaaatttctaccaacatatccaaagcactgatacatctattaaactgtttgcaacaaaaatacctatacctttttgaatttgaataaaaaatcccatttaaacaaccactgggatgtgattatgccccaaatctctctgattatagttggtttgctttattatattccacttgaaaattttgaattgacaagagggatgtttctgtgaactacagattttagaggaaaataagactaaagttttttgtatcactgtttggtgtttagcatttttcaaccagtaaattgtctttaaccaaaaaatttgtctcagagaatggaaaaagaaatgtgatgacaaaaaaaataatgcaaaaaataaacagttatgaaacagtatagagataaaaaaatcaaaggtgagatatcccaaaccatgaactatttatcttaatcatgcagccttttcatctctgaaagaatctattaatgtcatattcaaatgcttaatgttcactagcagttgataattatgatgaccatccctgtcactacaagatccttaagtgccttttgatgagcaaagaaaaataaaatcatattcaagtaccaactgttggaattcgtactttaaatacaacctgagaaatggccttaggttaaggctaatggtgtataacttgctcacatttctaaagagtatattttctgacaatgattccatatagaaagtttaccgcagataatagtttcttcatatttgcatcctgacctaatttttggtcattaggttactttttataggtatcaatattttccaagtcctagagaaaaatgagagttttaattttctcttataacctagctaccagatgctatgtggcaaggacagtcttaggatgaaattgtccagacaaacaaatatgtattagccatcaaatgtacacatatgctcataagtatgtgtacacatgcacaagcatgcatttacacacacaaacgtacacttcacagaattataccctgtattctgtcagcttgatggagtcccagctgttaaacctttgaggcattgtgacagaaatctgcaagaaagcttcactagaggcagatgagataatattctagctgcaggattcagctacattttcgattggagtcataggaaaaaacactcattgcaaaaatgaatgaaatcctaagcctggagtgcaatgaaattgtgtttaggctgtggggctcccttgattttttaatatcctattcactcaaggatgcttgtgtctgagcaaacatttctagcaaatccaccaatatatacaacactacttgtttttttttaatggaacattctgctaacatcgactatagtgattaagccatacttacacacttaacatactttacgaaataaagatacctgaagtacatgtagtaaccagtgctgctacatttgactagagatttagaagagttttgtttaagaccttttgaatattgactgactatacttatggggtacattaaaattcagtagcctctacattaccacacagcctatgctaaagtattttaaagtaaatttcagaaaagttaatgatttgtttttgttgacacttttaagaaccactaaaacctatgaatatggttggccttaagtagacactgtaaaatgaatgaggttgagagatattcatttaaagttctattagcctttatggaattattgtgagaagcccagcaatgttcagctcagtgttttacattcagatccatatttactttaacgagtatttcagaaagtttaatttctgagttgtctttggatgaatgagaaaataaaaggaattcagaattttatcaaccgtctatatctatgcagattatattcttttgtggacatatgtatgaaattcattcgttcatccagaaggatttattatgtgtatttcctatattctaggcaagcgcaaaaataatgaataggatctggcaactgcctcataaaatgtacagtctcctacaaatatgtagacaaggcaggtacaaaaaattgtgagcccttgtttattttagttttataagtaatgtgctcactactgatatccacctgaacaatttgattaacacaaaaaactggagaagtagattaaaaccatccaaaacattgggagatatagatagacagctgatagatagatagataatcatataaacatagatagtcatataaacatagggagattatatatatagataatatctatattatagaacatatatatgttataataatatgcaatgatatctatattatataatatatatactagaatgataaacaccgttattaggtgagctgagacaggaaggaggcgcgttggtttgcctctccagaccttgatctggctcagatggagctccagttccttgcactctagcacgtgtagccctctgctcagcacggccccatccttatgcgatgcacgacagaagctcgccctgctggaactgctcctccagaagactgctgtttgcggcattcattttcctttcattatatttttttctgaatttgttctggatcgttttttgtttaaaatctcttcctcctcaggagtccgctgggcccccttcttgtggcccggacggtgcacagtggagctcgcactgctgttgccaaggtgcgcggccggcagctcctcgccagggccccggtgcaggccggctggctgtgggtcacacgcagacaagatcagcgaccctcgttttgcgagtgcaacactcccagccacagaagttcccgggtccagcctcagagcccagtatttcccacggcctccccacacacaccccgcgtggatgcggcgagggcccgccttagtcctggcagtgcgcaccccagctcagactcccgcttcttgtggcagctccttctcttgcccctgtgccttctgctgcttgtgccagttgtcgtgagagatgcccggtgctgggcgctggttggaaagaaaaacttaggtatatattttctttttctttccttccttccttccttcctccttccttccttgctttctctcttttcttcctctttctttctctttctttcttttctctttctttctttcttattccttctctctctctctctttctttctttttctccttcctcttccttccttctttccttccttccttcctttttttgaaacggtctcactctgttgcccaggcagaatcatagctcactctagcccgaaactctggggctcaagcaatcctccaaccttggcctcctgagaagctgggagtataggcacgtaccctatgccttgctaatttaaaaaaagaaaatctttgtagagatggggcctcactatgttgcccaaactggtcttgaactcctggccttaggtgatcctccagcctcagtttctcaaagtgctaggaatacaagcatgaggcactgcacttgatcctatgtttttctaattagttttctacttttaaatgtaactgtaagttgtaatcaaacattatatatattatcctttaaaaaattctgaatttattgttatggttaaatttttatcattagtttccagactcaatgagagtcatttttctattaatggaaaataagggacagacctttcagcttacctggaagtgcctcatttcttttttgaaaattcctgccatggtactgatcaatgttgatatatatgtgaaaaaaataaagaggagacaaacagaggggatggtatttaataacaagagaatagtagagaaggagagaagacagttttaaaaatgagcattcatgggttgggcacagtggctagcactttgggaggtcgaggtgggaggatcatttaaggccaggagtttgggaacagcctggacagcatagtgagacccctatctctataattttttttttaattagctgcatgtggtggcggatgcctatagtatcccagctactagagaggctgaggcaggatgctcacttgagccaagagtttaagactgagtgatttcaccactgctgttatcagtctgctgtgattttaggtgtccaaggtgggagtgagtgatgaaaatctgaaaaagaattaagaggatgttctctttaatttacaaatatatttttgaagttgattttttgttatagcttagaaatctgtcatatattattattgcttcctctcacatattgcagtttttctttccaggaagatttcattttttagtgttgttttaggttcacagcaaaattgggcagaacgtgcagaaatttctctcatactaccggttctgcatatgcacagcctctccgttatcaacaccaccagcagtgtgcatttgttacaactgatgaacctacattgacatatcaataacgccccaaatctatagtttacattcgggtttcttttggtgtatacattctacgggttttgacaaaggtatagtgacacatatccacaattgtagtatcatacaaagtagtttcactgccgtaaaaatcctgtcctcctattcattccctcttctcccttaacccctcacaaccacttatctttttactttctcaatagttttgccttttccagagtgtcgtgtagttagaatcaaacagtatctggtgttttcaaattggcctgttcacttaatgtgcctttaggtttccttcacctcttttcatggctgatagctcatttctttttaccactgatattccattgtctggacacagtatagtttatttatccatttacctaccaaagaatatcttggtgactttcaaattttgataaatataaataaagctgttaaacatccatgtacaagttttttgtggacataagttttcaactcctttgggtaaaaaccaaagagttcaatggctggatcacatgtgagagtttgtttagttttgggggaagccatcaaactgtactccattgtgactgcttcaatagtaatgcatatactatatccacaatttattgaccacacaacttttttttttttttttttacccagcatactatagcatcagtatctgtcacagtgagggtttgcacttttcaggtagggctgttcttccttgggcaggactgtgctgagccctgcaggtcgtttattatccacggctcctgcccactggatgcaaatagcactgcccagtcatgtgacaaccccagctgctcccacataatccaaatatcacctggaggagagatagcaccttggttgtaatccaaaaggctagaggaacacaaacaggtcttaccctcttatgagctggccatgtgggatgctccaggagtgaagctagtggaatgtttttagtgactgaaagtccttaagaaatgtgaaaagtggttacctggatttatacatatgtaaaagtttgctgagctgtacacttaagttttgtgcattttagtacatctgagatttttatttaatttgaaaaatagtccctacaggaatttcacagctatataagttgttttctgagaaataactcagaaaataacttaatgttgggattattctccatccctgtagtcaaatgaccatgaatttccgtaattttctttcttagtctccactgtgaaacaatttgaattagatgtcattacagtatactattttttaagaatcttacatgtataggtgggaaaacaaaaacatgtatatacataagtttttatataacctgtatgtatatataggttatattcaattatattccagttagagttcaaccacagtaatttgctatttaaataaatgatattattaatgatattagtttatcccacatcattattaactaaagctgacattttcccaataaaatcaatttgcttataataacatcgacattcctttgatctactgtgtacaaaatgtgccagctctgcagggatgatgagttaacactctaagcagttcttttgtcgtgtcactgcggtgttatgagacatgaaagagtgtttgaatggatatggctataatgcacagtgtttcctttgttttcagagtaaaagccattaacagttatttcaggattactgtgtttatgacacttgtaaattgatttatggtattagccaggcaggtgattgaacaaaagccttttaatgtttgtgtatgtgtttatccttctcagcttcacaatgttgagtgattcagatcacacttcaggcttatggaaatttgctggacctcctccccataagaactgattccaaaccaggggaatagtttaacctagcctgataatcacataaaaaggagtttcataaagggacacttgaggtcagagagaagtgaaggtgacatccactccatcatgaaaatgtcaaatggctttatataagacatcttgcttgatgcagctcagtgattcttaagccattttatcatggagagaaaagaaaatttaaacatttccgagttatagcactgtctcagactattatacaaatccattgagttatttttaaaactataatttggatgccagtgtcataaaatatctcttcctgctggctataataaaagttgttgatctatttcaagcatcctgagtagaaaaatgttgtttaatgattttgcatgcatgaagttaatttctacctctggaactcatagtagctgaaacaacttaatgctgtttcttagtgaagaggaatgtcaacgtagcatgcttttttttcccttcttttttggctgtgtgcattccatgttgtcaatgaaaatggcagatggactgtcactgacatttctgctttgtgtagttgctgccatagaaatgaaaaagtttttaaaatggtgacgataagagtcaccttttgttcactgaatttgctgtgttatattttcttcttggaaatttgacctaaaactgtttgtgaataattattcagaaaaaatgtcaaggatttttaaaaatcactaaaataaaatgtgctatgtcaaaccagctgcctttctaagctgctttttgcccatgtatcacactcatcagattctatttccctctaggataaagtagaaacctctttttttaaattccagcatataaatttgaataatgttatttgcaaaagggaaaatcgaagcatttactattcattagagccattagagaaccatagtgccaaaggttttgtgtaaacatgacatcatgactgttaggtgaaaaaaacaagtgattattaggaaatgattattattcagagtacattaacaatagccttgggtctttaaagtaattttaaaataatttgttttagtgttcagtttataatggtggaatgatctataattgtccaaagtgaaaacttagtcttaaccatttgtatgcattgttgcctttctatgctttattattggaatttaaacagtctccagtggaaacataatgcaaagttggtgaattaaggatcaaagcattaaagaaaaatgaacaggcatcatgtatactaacagctaccaagacttaaatgatggtgtactataaaatgggcttacattttctttaggtgggctataactttcaaaactcttaaaccaagaaagaaaaagcaatgagttacattagttgcttaaactaaatatgcagaacatacacactgatgtttaaagaaaccccacattttctcatcttgttccaatagaagaggtgcagacagtatggtagctttaagaaagtctttttttctgtttgttttttatttttattttagatgtatggcagcaggcattctcaagattttgtctaccttttgcctaaagaatctccttactgctgttgaaatattttaggctgatttctgatttccaaagactgaataaacattaaaaatgtttccattaggaaaatgttaaaatgcacccccaatagaaagattagcataacctccccccaatcttgcactctctctctttctctctctctctctatgtgtatatatatatatatatatatatatatatatatatatatatctgcttcagcaatattcattattgcatcaatttgtttattctatctcttctacctaaattagctatttctaccttgaaaaccatcccaaaacactgattcaataaaggaaacatttattattgttcctaagtctactgtttctttgggagattctgctgaacttagccagtcttgactgatactgaccagctggttctagcatctgtgttcagctgacaggttagtagggcagtctcatctaggatggctgccattttacgtttagtggctggctggctgttggccaggatgatggggatgatgggcaaaatgtctcttatcttccaacagggtagtgcaggcttctttttaaaatagctgagcagagttttcagagacagagagaaagaggaaaaaggtgcaaggcttcttgaggcctagactagaattcatcctagggtcaaaagcctaccagattcaagaagtgaggaaatagcttcttaggaggagctacaaagtcttattacagagagtgtgaccacaaagaggggaagagaatcagagaagattttgcaatcaatctactacactctcacacttttggggagagtattttatatcaatcaatatcatttcaccactatatactttagagaatttgcctttattttgtaagttgttatgattttgtaactctaatagcatccacaaagttaaccatgctccttggatcagaatattagtaggagggactatatcctcattgccactatcaacacaatgatcatcactttcactagtattagcaaattttatttatttttctctgctaatgacacattacctcacttaaatctcataagtgtgctatacagcagcaactatcaccccagtttgtacagctgagtgagcaggctgggtaaactgcccacagccatctagcaatggtggctttgaacccaggtcatactaactttcccatggtctcatcactgcacatcactttgtcatgtgaccagtcaggaggccacagtagctttgcacttacttgggaggccaagtagaatggacaaagacttagccatctctctcctccatttctcaaggaataatatgaatttaaattaagggagcaagttgtttctagatttgccaccatggagcacttttaaaaacatcaaggggatctatgtggtcactttataatactcatgatgtgtatgttagaggcttctgttttgaagaggcaaagaattttatttcctttttgttgtgttggaagttgccctaggaggtacgcacgcttgtccatgttaaactaatgtcttgaaatcagtgtattcttaattcttatcccactagtcgtactggagaacctgagggagtcaggaaggttccattgcattgaagcgactgcattgtctggggtaaatacctggggttcattgtctcatgtcaagaaaatttagaacatggacacatatgaggagtttagaagcagaggtttaataggcaaaagaaagagaaagaaagataaaggaaaacaactctctctctagtgagagagaggggcttcccagaggaaaaggctggcctgctgcggatgcactatattttatagacaggcttgaggaggtggtgtctgatttatgcagggcccacagattggttcgatcaggtgtgacgtttacatagtgtgcagaaaaggcttgccaccctactcttattaccctaatcttatgtgaatgggctttccagttgaccggtgccatcttgtctgctccttactgtacatgtggctgggaagggaagatggagccaccatttttgaacatgattggcacaactgccagggtctatgtctgcagctctattttacaggttgctctttgttagaaaataatttgggggctgcatttcattgaaaaggaaaaccttaccgaggactctagtaccctcactatctgcctaagtaatttcttcttaactcctatgtcagtaagatgtgacagtaagatatgtattatgttggtgcaaaagttattgtggcttttgatggcaaaaaccacaataacttttgcaccaagctaaatttttcttttgaagtggttggcagggatgttttttttcctaaggatgagctacgatcgtaggaattaaaatttaacccagtttacccagattcataaaaattaatagatttctttgtggatctgagttgatatcattaatataagctatcagacatcagcttcatgtgacttaacttcaaaaatattttagtaagagtatgactggaatgtttataacacaaagaaatgataaatgcttcaggtgatggataccccaattaccctgatgtaattattccacattgtatgcctgtatcaaaacatctcatgtaccctataaatactagatactcatagaaagtaaaaattttaaaaaaattagttcttgtcttagtgccagctccatcctgagtttcaacaattgctattatctttgaggtctagcatgaggcattaaatgccattgtttcaagaaagataaatgggaatataattttattgctatcttactgttgcaaaatggaattcctaagaaacataccctttatgaattctggcaatgaaactaagactgactttccgttttcaatctgaaagctattttggagctttcatcgtcagctaatggagtcttacttgaacggggtcacatttaaacttctaataatttttatgttgtagcctgtgaacatacaaatttcaggtaaattgaagctaattcctgcaggaggtaaggtcatatgtagaattagtcattattcatattctgaaaagtgatgatgtcattatgggagagaatttcttgggtcaagaccatgcatttaaaacgattaaaattcaaaaaatgggatcaccattactgaataattagtatctataagctactttactaaaattagagaccagtgaacttactgccctaagtcaagagattaatggaaattgagagtgttctcacttatttggctatctagttattcttgttccctatttcagaggtgagatgatgttaaatattaatctggaaatacgatctcctagtagcataatacttgggaaagtcttgctccttacaaataaaaggcaactcataaaacacatacatgagatgctcttaaagccatcagcattgaaaactaatggaaccgagtattaaataataactagattgcaagtaaagattgatatataataaacaatgactttagatgactattaccaaactgtttcagaaaaaaaaaaaaacaggaaaaagaaaattcgaaggggcagggcattgatattttcctcaaaattttcatattaataatagctacatggtttaatgtctcccaactttgtacaaatacgtaggactcaccttttgtagttaaggcagtattttgctttttataatgaaagcatttttccatgttttatttcattgattaggataactcatttcatcagaagagtagtgtcaattaacatagtgacacattgaacatatatgttaaatttaccagtagaagttaaattacaagtataagttatttgtcattagaaaatattctgaagcatacatgagtcattttttccaattcccattttaagatgggtcagttgaggtcagccagagtagaataatgccattactctaattcaggacaaagattcacaacttttttggaggtgggagggtagtattttcttttatgattaatataattttgttctcaaagtaaagcataaacagtgttgctgttccttaagactgctaaaactgtgaaacaacagccattagttactactttaaattttaccaatcggtacatatatacaaaagatacaggtctataatatcttaagatgcaatttaaagtgaaataataaagcggaaatacttagaatttaatgtaagtttaaagactttactatctctgtgttagctaacttttttcaccagttctaagtgaacacatagagtaattgatttttagaaaacaaaacaaaattacatacctgaaagactaattctcacattttggagcaaattattgtattattacctgcaagaatacatgatagacaatgtataaacaatgtttagacatctattaacacaatgtttcagaaaaaaattgaaattgtaagagaaagtaaaaaaaattaaaaccttaattcttattctatttctgtaaactttgaaatgaataaatattctgtttaaatgagaagcatcttacgcctttgtcttctgcttgaaccaaactcacatttgtaaatttcagttaaaatggtggcctttattcttttgttctttattatttctttcctctatcttgctggaactatccatcttctattagtgtgaaaactttgaagatgaaaagctatttcaccggaaaaatcattgatgtatttgtgatccttaataatgactcaaatgggaatagatatctaatatgaggaactgagtaaaaaagaaccactttttaaataaaattaactaaatgaagttattgtcttagccattaacactcatcagtcatatacaccatggaatactacacagccatataaagaacaaaattgtgtccttgcagcaacatggatgcacctggaggtcattattctaagcaaattaactcaggaccagaaaaccaaataccacatgttctcatttagaagtggaagtccaacactgaatacacacggacataaagataagaataatagaatattatggacataaagataagaataatagaatattatggacataaagataagaataatagaataattgtggactactagatgggggagggtaagaaggagtgaggattgaaaaactacctatcgggtgctatgctcattacctgagtgatggaatcatgtatacaccaagattcagtggcactcaatttacctatgtaacaaacctgcaaagttacctcctgaatctaaaatagaagttgagaataaaaaagaaaaaccactcatgtgtataatatcataccttccaagtaaaacttcctctgacttaggattttttggaatagtctgtggtttacaatagagtatatattcgctgtcctttattttacatacaaagaggaaaaactaatttcattcatgcggagttatgagagaacagtttcataaggaggaaacatactgccaaaccaaaaaaaaaaaaaaaaaaagaaggtatttaatttgttctgttgaaattttagagtttgtgaactaacatgttattctgtttgtgtttttagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcaggtaaagttaaaacattcagtgcctattaatggaatttcatatttgcattttgatttttaagtagaatacttatggattgaggatgtgacttttctaccatatttctatatattctttagcaatctgtcatgagaattcatatctatctttttcgttttgtgggtggctgatacatgactgctgtaattattttgcaacccaggcttttagttccttatgcaaacttagaacataacaagaatagtaacctatagataagctagtatttttccatatgtcttggattatctgcaatattaccaacaacttcacttttgtatacttaggttagttaatcaagattcagaaattactggcattcaacaaattatgtcgaaaaggaattggatgaactttgtattctttttcaaaatgattatatttaagaatgaaaacaatgaattagcaaaacaataagccattttacaagtaaaagtataagatgatatgaactctcaaaatttacggcattatatagtgtgaattcatattaagaggttaaacagtagtctgatggaaatatataaatatatattctaacatatattggtaaaatggatgcagatttttagccattataaatcagtttgaacgaaccatggtaattaatagttaaaaaaatagatcagcatcagcaggacatggtgacacatgactgtagtcccacctatttaggagtctgaggcaggaggattgcctgagcccaggagttcaagactatagtgtgcaatgatcacacctgcgaatagacattgcacgccaacctggacaatatagtgagactttgtttttttaaaaaaataaaaactaaaaaaatctgcaaacagaacatatgtaatagtatatcaagtctgccatgtatagatcttgcagatttttcttgtattacatgcatatgggttctaaaagacccacgagaggttattaagacatttttatccgtatcattcaggaataatctctattgcatcttctgtatataatttggagggttattatattagaggtgttggttgtttattagaattttagcattgcaggtgatatttgtggattttctaaattctagagaaataatcttgagctcataaaatttaatacatcttagaaaagtgttgggacttaactaaaacgttgcttttgaagtgctcagacagactgaatgtcaatagaaaggaaacaactctctgactatctataatataatgtatttaaaaactattctaagggccaccttaaattacttgatgtacctattttatattatgcactttggaaagaactgaaattgtagttccatccccccaggtagaaatcccttctctattatttttaacagataagtaagctctgttttgacatttccatttcttaagaaattccacttatctgacctacaaatatacagacttaaagtctgctttacatttggctgaaatctttcggcctacacaatgtattagatttcttcactgaccagcctttttgtagaaattctggtcgggagtctaaagtaccttcatctttagtgaattcttttgctttgagtatgcagtagcaagttaagagcaagcttcttggtaatcctgtggaaaaatgttaataatttcacattgtcttccgaatagcaacgaagatgccactgagattactgattcagatttttgaccataatctctggcatacacatttattcttcatcatttcttactttgtcagtggtgaaggatgtgaaattttgtattaattcctggcccacatttttattctggttgtctcagttacttatgcattttcatgctgtaaggtccttagacaacaattgttataaaatattaatggcatattttcagaacatctgaatattattcatttatttcagggctctagagcactcacaaataaatgcaactaaggcagatatccaatttgaatgtcaaggagtctggtgtctctgtaattggcttaattatagaggaaaggatttataatgtagaatatatattcttataaacacccaaaggttattagctccgttccccaaataattagttattgctgagcctttacaaccttagcaaatttaggaaagaataatgttctaataaacaagttgttcacaagttattagctgatatctaagggactgtggccactgtgtatcatccctcaccgtttataactgcaataaaatttaaataatatgaatttgcaataagctcaagtcctgctctacacagaaatagtagtagtcagaaacaaagtaaatgtgaatgaaaatacagacattttgcatgttggtttatgaatatccagtagataaacactgaacttgagctaatatccataacctggtaaaactcacttatcagatttatcgggcaataatgaaaaattaaaaaaatagaattaatagaaaaaaattagagtttggaaaggcatttagtttttattctactctggctgtcaatgctcaaaatgtggtttccagaattcttggggtcccagggacacatccagatggtctgtgagattaaactgtttttatcataaacctaagacgccattttttcattttcactgcgttgtcatttgctctgatgatacaaaagtaatgagggctgggcgtggtgtctcatgcctgtaattgcggcactttgggaggcttgaggtcaggagttcaagaccagcctggcaaatgtaatgagacctcatctctaaattatatatatatataaaatatatatatatatatatatatataattatatatatatatataaaacgaatagctgggtgtggtggcttatacctgtagtcctagctacttgggaggctgaggcagtaggatcatttgagcccaggaggttgaggctgcagtgagccatgatcatgccactacattccagcctggcactggcatcaaatttactggtagtcaggtgatatttaatgtccatatactcagagtaaaaaactctcaaaacaaagcaaaacaaaaacagttttgcttatgattataattgttgaagcacttaaaaattattaatgttattaattatctaccttggaatacatactttctaacattctagtgaactgggaagtagatataaaataattctgctatgcgtcaaagtattatgacaatctctatttcttaattgcatcattgcttgagtcctgagctggacatcatctttactttaaagttatgactgacaaattatggttgttcagatagatataggtcagatattttcctgaaagtgaaccaagtgagcccattcatttcaagataaacaactgaccatatataaggtcattgattaaatgtgagtgttcaagaaaacattagaattgtggaggacatgtattgtccactgtaagcttgagagcttcccgatacttaatactgctgattagatcagtggcaattctaacaagtgtcaatttttgatattctataatgaaatgcatcaatgtttggaagacacaaaattcagtgagcgggtattttttccaaatgaaagctccatgatgttacaaaatcatttgtagattaaaaaaagtaaaatggtttaatggtacacagtatgaaaagttgattgatagggtttagatttcacatttcaatgaatgtttaaaaaactacacttgtatctacaatcatcagaaaggactctaaaatttcccatcattttttaactacgttatctgtgtacggctggattttctttatatctttgaacaaatcaaccctatttcaacagatgaaatgcagaagcagataaaagaatccatctgccttctcaagaaattgcagagatggcctttagttctagccactcgaaaggctgaggcgggaggattacttgagcttgggatttctaggctgcagtgagcaatgatcctgccactgcactgcagcctgcatgagtgagcaagaccctgactcaaagaattaagaaaaaagcaattacagagatttgcaatcatgtaaagtaatgcccttcttctcataatatttaaaggttttcataaaatatgtgatttactttaacattgaattattttaaataaattcataagtaaacattttgaaagacattttgaaagactttttcagtttttattcctgttatagtaaatattgttagctataccccacatgaacaaatgctctttgagatgtcttgtaatttgtaagactgcaaaagagtcctgagaccaacacgttgagaacaatttatctaggctaaatccttaatattacaaatgagaaaacagagagtggttcagggcctggtccaatgtcacaggttttagggcctcatttgcaactctactgtggaatagtacttatttaagttaggctctgtgcctgtctccaaattgcttttctcatactttatttgccaaagtcaggtccctgctgcgaaacagttttcatttccttgtgaatcaaccctgtctttttattagagattctaagaactgtactaaaactgggatgtctccttttgaaaaatattgagtgctcatcagcagtagatctttacacacttcatgatctatgttttatttcaaagcttaatccaagttgtatttccagcattagtaaatttattttatagttgtaattctcagaaatgtaatctcgctgctctactaggtgagaggcaaaatcacttcctactttatttatttatttatttatttatttatttatttatttatttttacttttatgaaagagtctcactctgtcacccaggctcaagcgcagtggcttgatcacacctcacaacagcttcaacctcctggtctcaaaattaatccagttaatttttacatttttttgtagggataagagtctccctatgttacccaggttgttcttgaactcctgggcttaagtgaccttcccacctcagccacccaaagtgttgggattacaggtgtgaggcaccaagtgtggcccactccctactttttaaaattgtgtttgtcttgtagattacttatcaaacactaacagagtttgtcacaagaggaggggatatttgaatatgaagaatctattaatgccattatgcatcagttattattatataataatggttattagtaagttaaattctctaaggaaacagaacaaaacttccaatagataagtgagaaaaggttataaaatgaaaacataaatgaggaataacaaacactaaacaagcccatgaaagaacatttattacccaaaaaaaaaaagaaaattaaaataaagggaataaggagtttatattttcctttgtaataaatgctaaactattttattattttgaaatgttagcattcactggtggcaaaaatatagagaaccactctatttttgttatttgtgtatatattctgtggtgaaatgatatttacaatttacccagagtaattaccacttgtgtccatgcctggaaatttatcataaatcagtaattcaaaaaaggaaaaatctatttactcaaaattcctattgaaatagtttacctggaaagaaaaaaaatggataataatctaatgaccagtaatagaattattaaaaattatagcatatcagtgggaagaaataatgtaaaagcagtacattaattataatgtgtttatagaaacacggaagattacaaacagaactttcaaagtgactgaactaagtaaaaatgcatatgcatgctaacatagattgaatgccaataattttaataatatatatttttaaattgtgatgacatagcaacttttcttctgctataaaaatcattaaattattctgggtttaaataaaatgaacatatattaaaacatgaaatgatggcagtgaagtgtattccttagaagtaagtacatgttgcaaagagagagtgagatttattctgattttcacttttgtatcatcctttcacttatcagtatacaaaagaggtttaaagtgttttcgctatagattaaccttgcctgctgtttgaatagtgtgtttttaagtacatattttaatatttagttcaacaggttccaacaatcataaaacagtcaaaagtccaagttgcctttcccttcgatgagtattttcaaattgaatgtgaagctaaaggaaatccagaaccaacgtgagtattgtttcaaacgaagtggttctttaaatgcgtgctgttctttatgctgctctttactcttaccatcacaagcctgttggactatgaatccacgcatgattaaagctaagggtttacaaaaaatcatatccatgcaaacaaaaaaaaaatttggttatttcacatatgtttttctgccacttgaatttattttgaccataaactaagggctgttattaaaatacttagagtagtctttggtacagcagaaatactccacaatcccttagtctacaaataaataaggtagctgaaaactagaagatcctttattctacttagtaaaatgtagcatttattaagtcaaagtttgtaaataccattctatacatatttataattgtgcgtctttaaatttaaacatcttattttgtggataggttgttacttgattttttttaagttgtcatagaaatattgtcatctcaggtggcagagtactattgcatgatatactactatctagtattattttattttagaattaaataattgttattctaggtgaccataatcactgatgagctttttcaaaataccttctatgtttggggaggaagaaaaaaatgtggatgtattggaagtgagaagggagaggctgtgggaagaattcccaatattaaaactctacgtgattctaaaatggaaagcaaagctacatacttttattattctgcatgattatcttatattcattaagaatatccatatttaatgaaaattgatgattttcaattgtatcatgactattattattgcctgatgggttgatatttaataatcattagtgacccattaacatgctaaattataattatttctatgtttaaccaaatggaatatattcaatcaaaatatgtaagtatggatagaattacaatggaattaaggataatttattcaatcaatatggatatattgatcaatatcatgatatattaatattaattagctgaattattatgtcaaaaggtaataccatacacttgtcaacagtgaaatataagacacacagagagaagtaaaataagtcaggagggtggctgggtaggcctactcctaatgagaatacatgtccattgaaggtttgttattcctgttggaagaataatcacatagattagtgtaagaatatggcgtcctgaaatatacccaaatttgcatgggtaattccaatatacaatgctgaatacaatctaattgggaagtcattgtttgtctatcagactgataaagatttaaagagacttcttaatgtcattgttcatagaactgacactctagcatactggggtgggaatttaactgtgtacattttttttctagaatataattttgcaacatttatcaaatactataaaaagtttttaattattggtttattaatcttatttctaaggaactggcatattgaaatatttggacaagtaccaaagaataaatatatagggttgtttctcacaatattgttcataaaaggaaaaacattgaaatggttaaaagtaattaaattagtaaccatatgacagaagataatgtagctataaaaattgtctttagtatcattataataatggaaaaattcagttggccaaattatatattcagtgtggtctcaaatatgtgacaaaattctaaaaatactaataggaaatattagcaagtgtaataatactgggcttatctgttttgggattttgagtgagttccttacacacacaaatacatgaacagaaattatatatgtttcttgtagtctccagaatattaataataatcttgtattacctttctaattaaaaataaataaataattttaatttaaaaaagcaaaagctaatttcaatcttaatcctctcatttatcaagctgttttatggacagtaatatttctcagattcttctgagacccttatttatatcctgttatattccattaagtatatactttttatcataaaatgtcttggttttgtcaattttatgcaattgttaataagtactctaaacatatgtcattatttttcaggattattaagttcagttttatgttttagattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatcaacttatatgtgtcttgtattttatttataaggaaaaatttcctccaggtcttgatacttaaaatcggatgaccttagaaaacaacataatttgactctgtttcagtaaccttatatctaacatggaaaaatataatatctgctttgccttataagatgagaattaaacatattattagttaaacttggctaaattctatgcagtaatagataaccccaaaacctctatgtaaacataaagttattccccgataaagcaatttactgtgggcctggcaactctttcatgcagccttcttgctgatcacagctaatggagacatcgtcattctgtggttgcctcttgtgaaacatgccattttggtcaaagagtctgggacgaaacatgaaaaattgtacactggctcttaaatgcttctgacaagaagttatgcaggcaactcctactcatgttttgttaggtggggcaaagcaagttgcatagtcccatctaacatcaatagtatgatgctcattaggaaaggagaaacagctattggtaatgttaaccgtaaataaaatttgtgtaaaactgcaagacactttgttgttagaggtgtatttatcagtaatcgtcccctgaagtagcgtactttattcatagcttatttgccctatgtgcatgggatatccatgaccaccttttatattttatcacgttttccccctgttcttaatatatccaccattacacaattttagccaaagcctttatagagtaaattggtaagtataaaactgtcagccagcttctattcggtaatttcttcttttagagtcctagatatgaaagtatttcaaagaaagtcctaggacttgcaaaatatgaacacttgattctgggggtgcagaatggccacaaacttcagaaaaacaaatgatgaatctttaacccaaaagttcagagagggcattgtatttaaattgtcctaaagtccttatataattctagaggaaggaatataggtcaaatttagactcggaagtaaggtgtgcatcttaaaatttataagtatgtacactaaaattataagaaaatagtattatcacacaatgtggttgatgcagggaagaaaaaataaaggagagaaaaaaagtaagacaagcagaaagaaaaagagatagaaataaattcaaatatatcacaaatgaaagacaaaagtaaatagaataaatgctctgagttaaaaaaaagctataaactttttacaacacatctatctaaaccttaaggatacagaattgttgaaatgaaaaagacagaaaagatatcccagacaaatgctttccaaatgaaggtaggtatgaccatattaatgtcagtcataacagactttatttgtaaaagccttcatggaaattaatttactagacatatataatgttaaaatacctgaagcaaaaatagaactacaaagagaaatagacaaattcaccataataatgagatattaacatatctttttcattatttgctcactcaagcagagaaaaacatcagtgagcatatagaagatttaaagaatacaatcacaagctccatctaatgaaaacacatagaatattgtaactaacacggcaaaatgagttttttcatacacatggggtaaaaggttatatttgatgatatattgggctatgaggaaaatatcaaaatgtaattaagttagaaatcaataataaatagaaaacttaaaaaacttatatctttgaaaactaagaaatacatttctaagtgagtcttaggtcaagtaccaaatggtaaggaaaatagaatatattttgaagtgatgacagtgaaaactctacataacaaaacatgttgaatgcagtgaaagcattatttagagggatctttatcattttaaagacatattagaaaaacataaaggatgaaaattaatgatcttagcttattaggtaacataattttaggataaaaatgaatgagctaatttaaggcaacagaataaactggagtgaagggagaaaatagtataaaagcagaaaataaattcaacaatgtggtatgtaatctttgtagtgaaagtatccatatttattaaaaaaagaaaaaatctagacaaatagaaaataagtaaactatttctatttattggaagaatctatacacttaaaatgctcattctcaatgggttgatatatagaagaattgaaatcagaacgcctatagtttagtttttgtttctgtttgtgaaatgtgaccagctggttcaaaaatatctttgaggaacaaagggcaaacttcagtagaaattattaaagaataacaagtcataggggattcttgttttcagaaatcaagattcagcttaattcaggaattaagccattatggttctgtgcagggttacacaaatcagaatagcatagtaaacccagaaacagaccatcacatgtgtaaaaatagttgagggaattggcatgttagcatggatctctctctctctctctcccccactctctttactttgaactaaacattgtggaacaattgataattcacacagagaaacatttatatggacttccacctcatatcatataaaaatcatctcagagtggataaaaggctgaacagtgaaaggaaaaaatgttttaaaaagtgagactatttgaacaatacgtttatcaccagggtcattaatacagagaaagatttcttttcctttcttttcttcctttctggcttttttgtttgtttgtttgtttgtttgtttgtttttgacaggaactcactctctccaggtcaggctggagtgcagtggtgcagtcatggcttcatggctcactgcagtcttgaactcctgggttcaagtgatcctcccatctcagccttctgagtaactaggactacaggcgagtgctaccgtgcctggccaatttttatttttatttttatttttgtagagatggggtctcactatgttgccccgggtggtcttgacctcccagcctcgagcaatcttcctgcctcagtgtcccaaagtgctgggattacaggcatgagccaccatgcccagtgtgggatgatttctttagtcatattaaagcctcatgaaggaaatcatcaagaatacattctcctacatttgattttagatcctttttttattgaaagactctaggaagaaagtacaaacaaaaataagccacaactcagataaaaattattgataatgcatataactaaaaatggtatgtattcataaataattttacaaatctttataaaaaaggaaaaatgacaaagtggcaacatatataaacttgaacctcagactggagggccaataaaaatgtgaaaatgtgttcaacctctttagttaccagaaacagacctattgtaaccctagtgataaaagcatttgatcctacccaattgggaaatatcagaaaatccaaaagtaaaaattttagattgcaatatacatccaacagaatacgtatccactactgatgacagtccagtttactgcgtgatctttggaaaacattttctaatcccctccttcgttgaagatgctcttacttatgaccaaacaattccgttccctagctcatgtgcatgtgcctcttgtccatacataccaggaagatttgtggtcacattgtttatatttaaaaatatgctggaaaaaatacagcagtccactcaaagtagaatggatcaatgcattgtgctctattcataccaaaaatactattcaatagtaaataaaacgtcaagaatatgttgagcaataaaagtaaatcttggagaaagtttgaaatatgtaaaactgactacaattttgattggtataattttattgttaaattataatgaaaaataagagaatgataaaaacaatattcatggcagtaattacctgtaatggaagtaaaaattggaaaatggaagtgggggttgagatcagcacctgacaaaaaggtgatgacgatattcctattttgtaaaatgggtagtaagtgaatggatttccattgtgtttctttctttctttgtgttttttttacatttattctataaacaattgttttatattcttaaaatgagtaagtgtgaagcatcccgtttgtctcaagtggacatttctgagttactgagatattttagaatcagaccagtgacatgtcaacctgaaaattgttctcaggagtttggatttgaattgactttcagtaggaaatgtccatgaattctggattagaaagtattgctatgaaaattgtggttgatcatcgttaaactgtatattacatttatatacttcactgaaataagttaagaccagagaaaaggacagataaaatatcttttgtaggaggcaagtcatgaggatgattcctaacctaaattctaggggttgctatggagacacaaaggaaaaggcagcagctagatctattgcaaagaaaggagcggcagaatttggtttaagattctgcaattaaaggatttcagtttttttttctgtcattatctaggcagaccaagtgaagacatgaacaatataaggataattctgaccagaatatgatatgagagtattgtattaagagctgggagttggatctgagctacgttgttggataattgctctattttttttattttttttttttgctgctgctgcagaaaagagcaaaataaattaggtttcttatgcatcatttccagcctctcctgaaattacttcatcatctgacagctttctgcaaccatctatatattgaatagtaacccaacccaatacttaggagtttataaatcagagacaatttaaagcttcctacaatctttaatcgattcttctcttaaactgtagagaattggttcttctcaaagattgatagaaactttgtgattcaaatgttacagtttctacttctcaatctcctgttaacaaacagaaacctttgtatacaatgtccagttttctattttcaacaacattgcagttaagtttcctagggaaagagtgaaagaaacaacaacaacaagaaccaaacaaacagaatgtaccatttttatatacacgaaaaactatttaactaaatgtattatccaagacatggcacagggattttgtcagtgagttattcaacaatcttcctgaaactcccataatacaccagccactttctagtaatttgggatttaacagtgaataaaaacaaagactgtcctccagaaatatacatcctgtgcatgtatatggtgattgggtctggaaaggaagggagctactctcttgccttcattatccaactatcagtaaggttaaaatgataatataaataatcctaatttgactgttgaatactactcacacttcagtgcacagattagatttctccacttagcattcctggcctattccagcctagataatttttttcctttttctgagtttttaaacaacttgtttgtttgtttgtttgtttttgttttgagacaggatcttgctctgttgcccaggctagagtgcagtggtacaaacatggctcactgcagcctcatcctcctgggctctagcaatccttccacctaaacctacccagtagctgggactacaggcatgtaccaccatgcccacctataaacatcttttttgaagtataatttacatatcataaattttacttgttttaagtgtataattactagtttttatacattatttatttatttatcttagagatggggttttgctatgttgcccacactggtcttaaactcctgggctcaggtgatcctcctgcttcagcttcctgaatagctgggattattggcacatgacactatgccccaccaatgacttttttagtaatttttttagtgaagtatcattataatgtagtattaaaacatttccatcaccacaaaaagatttcttgtgcccatttgcagtcactctctgttcccatctccaggccttaggcaaccaccaattaattttctgcctccttaaatgtacttttctggacatttcatataattggaatcatgtatatggtctttttcatatgtcttctttcacttagcatgttttggaggttcatccatgtagtagcatatatcagtagtttatttctctatattgctgaagagtatttcactgcatggatatcatttcctgttaatccatccaccagttgatgaacatttgaattatttccacttttggctattataaatagtgatactgcaaattctctggggttattaaagcatttagttgtgtactgttagggacagtctatcaattgtcatatgtattaattaggatccttaagaatgagaaaaaatatcagacagactgtcatatccttcccgttctgcattgccttgtagatgtcacaagaatgtgtattatatttatttcattgatttattggttgataggctgaaaaataaaagaatgaataaaagtaacactgcaatttgcacatgctattaaaatagtctacgaaatgtctgacaaagatgaaattttctatataataatttaatgaaaactaattagaaatattcatgcactaggtttctacatttgtgttaacatacttcctcagattcctcaggacaatttccttaagataaaccctggctttttaccaccctgattttggagggggagtgtaggaaacctggatgttgtagcctgtgctaaattctcctaagtgcaaatcaacaaaaacagatcaatttgttcaattaagggtgcaactttgaattctaaagctttaattaagttcgaggattttactctgattcaccaaagtatgtgaatgcctgtaatgaaatgggctgaactgggtgtccttccttagcatgaattcattatgagctcatggactgaaagccagtgttatttctctgtagtcctaagtggattaatgggatgttctgcaggaaatgggaatcaattaaatctctttaccaaaggaaaccggagttagaggtgataaagtatgtgcactcagtagcatgcagttgtgacaatgatggcagactgtgagcaattcgccaagcatatttaagtgaaatgtacggccctggaaagctcaccaggccagtcctgtaaacggagtgccaagtcaaaatagataaagctttttggtataggaagattcgtccaatgatggaaaaagggaaaataattcaataaacacatcatatgttctacatgaaatgaacaaatgaacaggattttcttccttctgtccttctacctcctctgaaaatgttaattcaaataattgcacaaagtcacagaagttgttgagatgcaggctatggagaaaatcaggagcagcagcagaagaaaactccctgtccctttggcctaccttgtctctgtgcgtttggctgtaccatgcaaagtgaaaatatttgaggagtagccaagatgtattgaataatttttaagtgcttgctcctattttaatcgattcatgtgaaatatttaaatttcaacataaatcaaatgagttaggtgttattacatttcccacttatgaatgacgacactgaaacatattaagtagcagattcaaagatcgcataggaagagaagccaggacgcaggcccaagcagctgacttcagtgtttatggataatctgatgctacagtgttgtctgtactttgagactcaggtaacacatgctacagatgagcaaaaaggcattgtacttctttgttgaaaataccttgatactagattacagtatcatctagaaataggaaaatataaggaaaccttctattttgttcctagagtgccggagaatctgtagtgttgcataacatggtagcggttaagatgccagtgttttttggtttttgtttttttcatcacagtggttagttagcatgaattgtatttagttaaatttccctgatggcatttcactactactcttcactattaaacatgttggcatgatgggattacacagcttaggttttattatatctctacccttaagaagcttctaccctggtgaggtgtttgaggagcctagagagatgaattcaaaggattctaagacaccaaaggaaaacaaaatgagatacagaaaaaggtaaagatattggtctgaatctttgtaaccagttagttttctagtgcctgggctagaacctagtttatgctgtaggatatcctatagatataaattctgttttcagaagtcttctttatttcaggaatgaagatgctatttttctgtatattatgttgaaataattgggatgatgagttttcaaaactcattgacagcatctgaagtcatagagctcctgcaaattttgtatctgcaggttggttgtgccttgatagttgtggtaataagactcctgtgcagctagcttgtctgtagggaagtgtttccatgatggatttcaactggggaagttttcaaaaacctagatgtgaatatatttgaatgtcacttatacccttggtgttagttgttgctagaaatctgtctatgacactgaataataaatgtgaaagcctaatggagaagagtgaaaagatagatgctgtgatatgcttgctttgctgatgcaaatggattaatagtggcattagatagaaaggaaattgatctcatctagacttggttataatgggatttccaaacattcttttgtttttgtttttttttttttttttgagacggggtcttgctctgtcgcccaggctggagggcagtggcacaatctctgctcactgcaagctccgcctcccgggttcccgccattctcctgcctcagcctcccgagtagctgggaccacaggcgcccgccaccacgcccggctaatttttttatatatattttttaaattatactttaagttctagggtacatgtgcacaatgtgcaggttagttacatatgtatacgtgtgccatgctggtgtgctgcacccattaactcatcatttacattaggtatgtctcccaatgctatccctcccctctccccccaccccacaacaggccccggtgtgtgatgtcccccttcctatgtccaagtgttctcattgttcaattcccacttatgagtgagaacatgcaatgtttggttttttgtccttgcgataatttgctgataatgatggttttcagcttcaaccatgtccctacaaaggacatgaactcatcatttttatggcttcatagtattccatggtgtatatgtgccacattttcttaatccagtctatcattgttggttccaggacatttgggttggttgcaggtctttactattgtgaatagtgacacaataaacatatgtgtgcatgtgtcttcatagcagcatgatttataatcctttgggtatatacccagtaatgggatggctgggtcaaatggtatttctagttctagatccctgaggaataacactgtcttccacaatggttgaaccagtttacagtcccaccaacagtttgaaagtgttcctatttctccacatcctctccagcacctttttttggcatttttagtagagacggggtttcaccatgttagccaggatggtctcgatctcctgaccttgtgatccgcccacctcggcctcccaaagtgcaaacattcttgaaattctgcttagctagactgttatgtgcaagttgattctgatccctttgcagagaggccattcaggatcaagtccagtcttgttgaaacaaagttaagtgatttttggttttggtgttgatgaagtacccatgtgaaatatattggcaagataaaggagtgtaattacctcatttaccgaaaaaaatatttttttaatttacttttaaaaatattactgttgtccaaactcagcaatgctaatgtttgtcaccagataaacacagtaaatgccactggttggatttatttttaaatggagtcatttctttatctgaattgaggtagacttcatgttagctgctgtgttatagtaattaaagttcacatttatctgtgagtgttaaaattttcactttttatcgtgccatcaaactcactaaatagtttcagagtcaaaggataagacataaaaaattcctgaaaaattaatgccatttatatatcttctaaaaccttaaatttattgatgtataagtatgcgtccctgttttccaatattcattttgtatttagttaaaagctgttctgaagatttatggcacgcgatagcagttttggtagagttataaattttcttttcttttttattgttggtgccttagaagccagttgaattacaaatttacattttcagaattagaattgtataatctagatttaattaatgcaaggatgataatgcttcagtggcagtactatctgttcgaattgctaggttttttttaacgctctcagggagcagctctccaattagggatttatacatcttattaattaactactttacaatagatattatccagtgaactgtgtattcatattagggactgtatagtttgcttgttatcgaagtggattacatgccctttccattttctaatccatattttatttcctctgctgcctcttgtatctgagtatagatagattcaccaactacccaacagcaccactgacttcaatgccagtgtttactgggcttaagttacagcgaataaaactaaataagtggttcaatttggagatttgggtacataaacgttttgtatattactatgccttatgtctataaggtgtactttctgcaaaatgttttccatagcatttgatgtcaatcaaagccgaggctttaccaaatagctggcatgatgttttatctacaagctcttaatgtagtgaatatactaaacatactttcccgacttttgagggaaatttcatgctacctatagcaaaaatgtgattcaaagatggttgctatttcaaaaatgtttccagagactttctaaaaggaatcttatagaacgagttgagcaagaggaaacccactaaaggactgtcacatggctgaatgtataaagagaaccaaagtctgccttccgaaattgcaaaggcagtgtaatagccacaccgccccctgcaatgttaagccttggaaggtccttgaatttagacaaaaagcaattcactgtaaccagctggtgcatcgataagagaaatgtcagcaaattccctcaacctctaaaggcatggatgggggttgaggggctataggacaaatatataggaagtgcacaaagcttctcaagaagaaattttacagtaaatgagtaaacctttatatttccaagaacaatgaaaatcggttgtgaatcataatttaagaatgaaacatacaaataaataccttctaatgaattccatcaagttgggactgttataactgccttcctaagatccttctcctccacaagagactgtgtaattctataatgcaaattcccccaccaaaagttgaaagatatcaatgtaatgctcaggaagaatacattttgaatatccttataaatatcaatacttccataaaaatattaaactttggtgttagatttcaaattctgcacaattctgacttatattctgattataactgcattgctcttttaagaaattgactccagtgtggggaggaaacaataggttgaaatattgacaagtctcatttcctacatcaattccatttcatttaaatttttatttaatgggagtaatttcaatgtggctggctctttttgcaacttaaagtggtcaaatttggctttccattgcattcttaccattttctccatatgggctgggaagtttttatttagtgtggttaatgcactggctggaatatttgccaatcacattcaaggccttcccaataaagcgagagatagagaatatgcaaccgcccaaagtgaaatcagtgtttggagaaaaagatttcacatctatcaaagctaaagcaagaaaatcctgtgactctgggtttatatctctgctcagagaaatatgcacaagtatgttattgccttattgttgtcgcataacaaaaacattattgtctggggtttcaaaatgcagaaatatttttaaagttgtgtaaagatgcacaccagtttcttaatagtatttaactctgaaggggagatgtaagaaccaggatctgtagcatagaatttatttaaattgctgaattttgaaaaaaaagaacatattaagatatttgttgttatagtcaaagttaattttaaaataacacattaaaatgattttttacaccaggtgttccaaaattcccaaaagaaaaaattgaccctcttgaagtggaggagggagatccaattgtcctcccatgcaatcctcccaaaggcctcccacctttacacatttattggatgaatattggtaagtaatgctccgttccatcaaaaaagggggacattttaattctatccatcatatcaataacataatgaatccaaagacaaaataaaaaataaagatctcttaattttttcatatttgaagaggagatgctactaatatgataagatttgtctgtgaagacaatacttcctatatttcaaacagtgcacttacctttggaatatagatcatgtgaaagctgaggatggcatgggtttgtgttgctagcttcatctttctattttagtaatgctctacctgctaattgcagtcacctaccaggaaattagtattaacttttttgcttaattttctaaaaggtttgctgactctgatctgaaaatctagctttgtaaagtctacttctagcatatgccttagcagtgatctctacatgttttctcattgtgaaccatagagaaaaatgctatttgcacagcactcagaagaaagcaaatgaagctactcttaggtacagccaattgttccagacatcagttcccctagaaccttccaggctgcaaccagaacagggagattaatatcacggataaaacttttggagagctttttgttttttctttttaaatcatgttttaaataaacgtgattctcagaaaatacaagtgttaattaggtcattgtctgcattgatcagttttcagttcagccaattcagattcatagggcagaggtggagacaaagatggtaaacagagtttaccactgtttgtctactggtggacttctttggttaatggtaaaaagtatcctcccaagggttttgctgctgtttttgttttgttttgttttcctatttgctcattgttcctgtagtaagaccagacttgagaggaattaaagagcaaacaggaaaaaccaaatgaaataataatgtaaaagaaaatgaaaaaggaagatgaagcacagtaagggacaattgcccttttcaatggcaagatatctcttttcagaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttgtaagtccacataatttatcgtttcatcatgtatgctgaatgcaaatgtgtctgtaatttccttctggctgaagccatttaaagctgggttgatattttgcaccattgtgcagttcaactctggagacttcttccagatgaaatagacatctgcagctgcagattcacggtagctctgtctctcacagccaggaaatcacatctcaattcacaggacaaatgtatttcatctgacatctgcaggatcttgtcattttcagtggatgaaatatacaatgaaattccagggttttctaagcaaatcttgggcatcgattcactgtgatcttggataaactggcagactgaaaatgggggagaaaacaacagaggcaaaaagatggaaatttgtatcaccaaactggcaaacttacttgaatcaccctttcccgacttgattctgtggaggccagcctgggttcccaaatgggaagagtaattagagggaggaagaaccgtaagattcaaagggaagaaataatccccaacagtttgctgagcgaataattggccctggtatagttgaaagttggcattaccatttcattgtttaatttggtccatgattttttcatttttatgtgtagatatgccatgccagggcttcactataacattcttctagtagcctcagttctcttcagtggagctataacttgaatcttctccacctggattcaagattaaactcactataattattttctatgtaaaactatattcccaaaggcaatgttctagtgaagcatggttctacatcattttgtaatttttctaagacaaaaatatgacttttcattctttattgatatcagcatccaccattatgtttgtgttttttccttccgtttttttatttcagtaaagcatgctaatgactcaagttcatccacagaaattggttccaagggtaagttgaacccatgtggagtgttggcatttgtgtatagctcattgtcatctcagattttgaattttttctttaatatcctcttaagtttattacaatactgttattatgaaaaacatctgaacttagagggttctattgccccccatgccctcttaaatatatgcaaagggagtgatttttataaatatataactgtataaatataatgaaatacttatatataatgcattgaatagacagatagagatatttaatggagtaattattttgggtctcccaaaacgtctcttatggtatataaggttgatacttttgcagaaagaaaagaaatggttaagtgtcaaaagacgtagagaaaacactgcgtttaagaaagttaagtggatttttttcttgcaaggctttttgaaatatttgacatgcaactgtacattgtggctttctgagaaaaaaacagtttgtagcatttttcaagttcatgtgtctgcgtgatctttttatttaattctttcccccatagaacgtctaccagaacttgtgttctatggaaaatgcctgagtaaatctgagttgtatagcaggctagttctctataatgagaagagtcagttacataattgcagcaaatattctctataaaatgtggaccagtgataacttagataccttgcatacttgcaagttcagtggaggaggatgtaagctccttttgaagaaccgtcagttttaaggtggactgattcatccccaacatcatttcctttgagattaataactcacacatatatagtgctatattttcacagcactcaatgaaaaatcattgcacatagtacatattcaacaattatttttcaaaaaataaacacgaagtatagaagactgtctactgctaaagtccctttgaagatggaagtcttctaatttgccattgtatttgaaaaatattcttaagaaaataagaaatgggacacttcaatatgcaggtagtgaggatgcttactagtcatttcctaaaactgtgtttttctttaaggagctgagactacaggtagagttgccgaaagagcttgataaattcatagatgcctagtgtctaccacagccttcctcagtgagaatttctgagtgcaggagtgaggaagctgtttttagcagaaacctcgttaaattcttaggcaatttaaattaaataaaaacataaacataaagtcattgcacatgacatgattgaagtatagaatataaaatcatagattttcaattaaggacttctgtttgaccttctgagttagcagatatggtataaataataatatttataaaattttgcagtgctacgctcagtaaaaacatatgagggacaacccatgcttcatggtaagagagaagaggagtctatttaaatggaaatatgtgaaatgtgtatagaacacacacacacacacacacacactcgtgtgtcggattttttgttttaagaaagatgtggtgtcacagaattttatgtatattaatttgaaaaaattctgacttttcttttctattttgtagcaaattccatcaagcaaagaaaacccaaactgctgttgcctcccactgagagtggcagtgagtcttcaattaccatcctcaaaggggaaatcttgctgcttgagtgttttgctgaaggcttgtgagtaacctgactctcactcatgactttgtccatccagttctgtaaagaataagacatcaagcacattaagactgtgcttgcaaagatattttaaaattatttccttaaaaaaattaaattctgccgggcactgcagatattctgctcaggactgttattccaggtacttaagaggctgaagcaggaagattgcttgagcccaggagttggaggctgcagtgagctatgataatgccattgcactaaaacctggatgacagagaaagacctcatctaaaataaaatgaaattaaaattaataaaataaaataaataataaacataaattctgtcattatatctctggaggaagtaatttgtacttcactctacagacttcaggcagtaacaggctcataaaattagatctctctgtcaatttatgatattgtggatggaggggatgatgataacattctccttagttaagtttaagaagcctgaggttgttggtagtcagtccctcacttttggtgctgagttttctctctatgctatactacttgccccactcctgtttgctatgttacttactaaatctgctgctttgcaggttccaaggagccctatttatatctatttttactctgctgccctttgcacacatggaggtccagaccatgtaatttaagagagttttacatcaaaatctaattaagtgaactttctttacacctgaaaaagcaatccatttatttatttatttatttatttaattatttattcatttattcatttatttatttttttgagacagggtctcactctgtcacccatgctggagtgcagaggcgcgatctcagctcactgcaacctctgcctcctgggttcaagcgattctcctgcctcagcctcctgagtagctgaagctacaggtgtgtgccaccacacctggccagttttttgtatttttagtagagacagggtttcaacatgttagccaggaaggtctcgatctccggaccctgtgatccacctgagttggcctcccaaaatgctgggattataggcatgagccaccgggcccagcccgcaatgcacctttttaaatcctccaagaaaaccctaaaggacctcacttggtcacctcttaaaattgttccatttattaactactgttaagtacatgtaaacagggaccatcttatttaatatttaatcatacagggtctcctatttttaccactatccttccgaacttacggtccttccctaccattgaggataccttgggaaaatgcattccagcttcctagcacctgggattactcatttgaaatataatctgttcgtaagctaagggctttggggactctagttagtggactaggatttgaaattcaaaaaatcatattcattcataatttagagtacattctgaacgactggtttagaaatggagcagattttattggttttacagcccctaagctttgtaagtttctctttccaaccaccaaaaatatcaaagttgcttgtctgtcttcaactcccaatgtgtatttacataaattagttagaagtactatgacacagactctgtttggaatgtttggtctgtgtattattttagaagaggaaagtctcatattgagtttgaatcatgatggcaacaacctgctctactggttgtatttgtacatgtttacagtggtagaaattacattcttgcagagttcatcactgtattgagttgggcagggtgatcctttctgtaattcttttttcttatttcccacaaatgccttcactgacctcttggattgactagcaactgcgcagaatgtcttcaaaataatgaaatgctctcatgtgctttttagaaaatgaagagtcatgaaggaatatataaaaacagagtggatgaaaatatatgttgttgtgaggacatgaaaattcttgatgcgctgtcctaagacttttcacctgaagtagtttcttcttactcatactgattttgtgttgggtaatcctgtctgatctgggtcgtctctcagaagatgatacatttttaaaaagttttttgggtcctttaaaaaactctttctaagaagttttcaagccattaacctcctatagtaacaaaaataattataattaaagtattgtactattattttgtgtcaagcactatatttgggtctttgaaaactagtctaattgtctaatacattttacttgaaagaataaagtaaaatgattatctataagtgtcaggtgaacatgagatataatttatctcaagataggtctatatcttggcaagaatttccagctatattcttgcaaatgtttttcatttccttttgttttagatttaagggatatttaccaacagtatctgaacaaatgtgttttgagggaaaacttataaaatggccatagatggactcatgtgcactgctcaaatagtttttttttctgttttgtaaattcgtgggtttaaagtaggtataattctttcacaagatactactttataaatagagaaatatgcaaataaaagttggccagacaaggacctgaaaaaaattgagattatgaggtagtgtattttgtgtgcaaaaaggcattaagcaatatattttccctcaaaacacattgcttaaatgctgttagtaaatgttatttaaatttaaaaaaaggcaggaggtataaaaaaattggcaagaatagagctgaaaatttttgccatggtatagacctatcctgagattaaattatatctcattttcacataatactttagatcattattttactttattctttcaagtaaatggtattagaaaattagactagttttcaaagacccaaagactagggagtccgggagatcttgctgaaagtgagttacttgctctaataaaggatggactcttgaaaaaatcctgttttaggggaagtgagttccagagcagcctataacttggcaaattgtcattttgacagatggagtgaaaagccagcagttaggagacttgagctatgcatcctcttaggtggtgtgctcagaaagccagcagctaatatgctctcacagctgtctgcccaggcatcattaccatttcctacacaagcgtgccatgtgctcttagcctggtaaaatataagattattattccaggctgcacagcacgttagtgtttgaggcttgaaggaagaaggaaaagagtagatatatagagattaaagagccttcatctttacctccaattttttttgcataaataactgaattattttaaccacaaactatcaatacaaataatttgagaatattgacacacacgatttcaaggaattgctcaattattacatagtaactaatgggcaatttgacaggaagcatatattctaagactatagagttaggaaggacataggttgaaaagcacaaaataatagaacacactgataaaaaaggaacaagtttagagtagacaaatataagttggggtatatcatttattgctccagtgaccttaagaaattaatttattggagcttcagactccttactgttaaatgatcacaataatatgcccatctttagaactcaccaaataacctacagctactaataacaagaagaaatatggagaggaaaagtgttgcatcaataaaattagcaaagttgtttctcctactcacttatagaacctgactggggaagagaaagagacagtcatccttcatttagaaccaaccctttatgctttccacataatttttaaatcaaatgagtcacagaaggtatgacttctgcacttgtctgcttttcatgaggaggggtttttcttaatgtagctgccttgactccccagtccttttttcctccttactaaggtggggaaagttatcatgctggtgtgtaacaagttatcatgctggttttgttttgtctttactttcctgtttgttttgactgggtgagctaatcttttgaaagcgctaagcaagggaagatttggttcattcctcctttcctctgcttcccgacaagggcgagaacgtgatccaggaggcagtatctgtgctgcagattccagcttgccctggaataggctgttcatgggtctaatcgacatgtccagctttcacgcaggagccccattctccatgatcagcatcataggattaaaagggaaacttctctctgctgactgttaagtcccactttactgtgttttacacaaacagggaatagggctgttatcactggctgccccaaaccacccactgggagattttcacacttggaaaatatcttggtaatattatttcaatgagctccagctatttttccttcgctcagccacacctagtcagcacttacatgtagttagcccttgtaatagaggagagagaagacttccaaggagacagaccactggaggaactttcagtgaaagagacttgcttcaacaccagtgttcactattgttggtggtgggtgtgtctgtccactggtaaggatgacgtgattcagtggaatatgagcacatgtgtaaaagcaccctgataaaggatgtgtcctaaggttttctttgtattttactttccgcttttaaaaaaatgtttatttatttaactattttttgcaggccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaaggtacctttcccatgttggtctatttctctgcttttcaaaaaagtaactgtatacatgtagtaggccttgcttctaaatcatacatgttaaaacaggtcagcagtttcaacttttaattgtagtgcgggcattgaattatattacacttcaactaagcaggtttgtcatttacgccccaaaatgacatagaagggacaaatgacaagaaaagatctcatgttagggattaaacacagacagtttacatgatttattcaaatagtcattaaagctagtctcctaaattatttttattgtaatacacatatacatttcataatattaaatcataaaagcagcagtaaggattatgatgaaaggaagtattaaaatgagcctggaagaaagcttggatttaacttgctgtgccctttgccatttatttcactctccgtacctcaggctcttcaccaaagaagtgaaagaggcaggcaaattgttgtgtcagctctttcctgcatataacacttttgtaatccatatcttgggttcagatgataaattcagtatgttacttacaggcaaaaaagaatagactgtatgctataatattaattctctcaaaaagtgcaaaaacattatattcaagtcatcttctctctgtaaattcagagattttgatcaatcaaggttttattggtattagttacatttataggaataagtaggcaaagatgataccatttaaatgtggaatgtagttattagtgctgtgactggctgatgtgaagtttgtctagtcctctgaatgtgattgacacagactattttctgtggatccaatcacactgaggctttctatctacaatgtagttgaccgtattgatcaaattaatggaatgatgactgcatttgtacttatttagtgcagtgtaagcttagctactgaaaggaattattctttttagactacaatttagtgaactagtgctctaggcacccattaatattccagtaaagttcacctcttaaaactttagtttccacaaggaacacctaagtaatggcctgttgtttaaattaatggaaaaaaaaaaggactcagacacaaattctcctcccaagtaaatgttaacacagttgatttaggcaaacccctgtttggaataacactgcatttccaagccttctccataatgcatattattatttaaggtaggaagaatagaaaaccgaagttgagaattttattttctttgacttgacaaaagcaaaacttatatagatatgcattaacgtcaacatctgccaaacagtgatatattcctttgacattaaattattcacaaagaaattcaaggaagaagagtttgaaagatttatgttatgtatatttttagtcatcatttgatgtttctatataatttggctacatcgtgcaacaggggtatttttctgtaaccccctcctcccctccctggcacacacacacccacgaaccagacatatctaattgttagattctcctccaagttgctgactattagaaacacttccagatggctggaacatagctacggtagctgaatattttaacaatctggccacagttttcttgactataaaaccaaacctttcaaaagaattgcaagggttgcaaaaaacgaaatcaaagatgtaacattaattatgcaatttaaaatgttgactataggactccaaaggaatatagatttcctgaacaaattgttctcactactcataaaacagctattagcactattgagatgtaaatgatgtttttatgaagaacttttaatcctctctctttagtaagaaactattaaatgtaccttcagttgtatgtttttgaagtttctctttacctatacacatgaaaaacaaattgagcttaagaagtctttacttttttttctaaagtgtggaggtaataaataaaaactttgttaatcatctggatggatgagctcgtgtttattcaattttttctgccttcctgcaccctctccttttccttttttgtctcttttttagaagcccacattaaataataaggatttgccatgtgagaaaatagcaatgctattgtatattttgaaaatctactccattctgaaaacacccattgtgcttaagtaaaatcatggattcgattggattctttctgtatgtgcaatgtctttcctattaccaaacataatataatcaaatactatgagcttgtaatttaggttgcaacatcctaaatataaaatcagactgcacttcaaatcctataatatgtatgagcaaaagcagccaggatgtcttgactaggtacaactgtatattctaaatatctaagatatgattaattacacattcaataaaaagagatatattatagtgacatctaaaacagtctacatccagaaatcaaaatataatcacaatcacatttcaatagactatttaaaaataagctcccaccaataatttttatgttgtcaacttttgaattatttaaagcctttgaattttagtaagtgaaataggaaagcatttatatgtaattatagagccatagtataatccaaaatgtttttgcattttcaaaggttgtcataaaatcaaatgcaactcagtcattaatatacttgagaaatccttgttttcaaataacaaacctatttctaaaatgttgcgattaaatccaatttttgttgaacctaacaagttttgatttattaaaatatagattttaataagaacctgtgaagaaacagttttactaaaaataaccagtgttgtatgttctataggtaccaagtttgttttattttgtttttttcctagtgataaacatctctatttagcttgcttaatatatagtcccaatgttcagacatttgcatctgtttccagcaacatgagaaatatttatcatcttatttttgtatttacaattatgagaaaatgcataaagtttcaacataagcaattttcatctgttaccatatgtcttaggataatagataaaagaatgggtttctatgaggatggtatttttcctcagaatttttggttttaaggctcaagaagcagctgtttctgagcagaacaagcttgactcaagtccctcccaatattacatgattcaggaccagcttacttctataggagaaatggatgaaaagcattaaagtaaattttcaagcaattataaagaaagcttataaagaagggttaaggtaaagtatagtgaggaagcctagtgaatgctcagaacttcttgagtcagttgataaatattgggggagcttggatttggaagcataaattgggctggccttctttcctgtctttgatacaaattcataagataacactaaattagaaacaaaaaccacatgacttcagagtctaaatgctgctcatccatagttgctgtgtatttatctgtggaatggcgagaacaggaactggagcttcctttgctggtgggcctgggcaagttaggcaacttctccaaagctcagccctctgtctgtaagatgaaaggattggatgacgtgataatttggaacctctttcagtaatactaatattactaatagtcctaatagtaaatatcctaatggcaatagtaattattcaagaagatttacagaaatatcattattgcttgattttctttatttctgcatacgttgaaagcaatagttgtaattttctattataaatatgatatgccataatgttcatgttcatggaatatttttctctaacttacagatatttagttttatattggttgtattaaaataaccagaaaaaaagtaaggatatcattaaaaaaatgcaaaatagacaaaaataaaccttcacctcagaaaatgatcgcagtttataatttggactagtgtattttaaaccaagtgactaaacatttacaggtagtacagcttatgaatacagatatttaacttggaatttaacaattaagtccacaccctgtggagtaattacaaaggcacttatctcacttggacttgaacttgaacttgccaaggctagttgtgtacttttgtttcctctgatgaacttacagttctttcctttttacataatcctctttttcttcctttacttagaaaaattttaatgatattttttcattgtatacatacatatatctttgaagactttcgtttttagctaaaaatggaaatctaaaatatctttggggaaataaccaaactacacttgatgggagttgctacctgcaggttttgtgcaattttctctgaaatcaaattatccaaaccatcaacactttaatctaaaccttttagttacccctgacatagcaatattcatgaagttataaaacatagagttataaaaacatggaaatccagtaaaatgtgtcatctgtttctgacatactttgtagtattgttacactggagcattagggcatagaaagatacaggtaattttaaggtatattttgctgcattgttttgactgcagaaagctaaacactgcttttgggcttctctctctcccctcttacaaaaaaactctaggaaataatatttttcaagtagattatatgtataaatgctataagatcactaagaaatattcaaaataagcattaaatattttaattagttttatttttaaaattcttacaatataattcttgtgtatccacctttttagatgccatgctgcagcttgaaaataacctgtagtgagctctaaataaactcaccatctgcttattcttccctcattttttcctagtggggtagctacttgtatagctaaataaaatggttgtatataactattttcagtatgttgatgtatgatacatgctgagtccaaattaaacacaagcacacacacacacacacacacacacaccatacaacacaaaagcagctcccaccttgctttgcagagcaagtttaccaaaaagagctactatgaaaccctttgtggtgtctgccctctgctggtgcaaagtagaaatacaggccttaacatttttggactttttgacatagataacatctctcatgagctcttcactttacatccagagcctcctcgctggacaaagaagcctcagagtgctgtgtatagcaccggaagcaatggcatcttgttatgtgaggctgaaggagaacctcaacccacaatcaagtggagagtcaatggctccccagttgacagtaagtttaaaaaccaattgcaatgcaatgctgaaggccctggtttgacgggattaatgatggtcagacgtgtgtaaaatgaagttggtatgtggttggattagcaggacagatacaaccagcaaatcagagattgtttatttctaagcaatttggttgttaagacttgatattcatggaagagccataaataatatttatactgcctgtgccctcttataaattatatataagaataaagatttttaatttttaaaaagaaaattgaatgagaaagaggatgcatccaaggaaaaaagccaattattgttcctgtccctgagaagaaacagaacagtagcctagcagctgagggcacaggttcaaagtcaggacctcctttaggctcaggcaacagcaacacctgtcctgggctctgcccttttaagggacttgctctgatcaccctctggtcccgcttgtctccatgatttgaaagcatcctcagggaaaaggaggcatcccaagtctgaacatggtcccattactgcctatttgctaccaacctcaagcacaaagacctgaaaatccccatgcccggtccaccctgagcccactccaaatgggctgggcggggaaagacaggaatggcccagcactgagggccaactctccccatttcaccatgctcagcatagagctccaaggagtccccaaatcttccactggaacctagagctcagattattttggatgtccttgttcaggaagaaggatagaacatatttttacgtgtcaattgcttaattaagagcaggtacgatagtggcttccatttgtccttttgctctggggcctgcacaagtcaagggtgagccacttggtggataacagacctcgggtcccgtctaggatgtgcaccttgccagctgtttcatcttgaggtgttttctgaatctccccaagcttacgttttttaaactgcaaaatggagatagtggcggttggttgtgcttgaatgaaaaaaaatgtggccagctgcctagggcagtgattcatctgtagagcactgtgatggtttataaactctggagccagactgcctgggtttgcatactgactctaccacttactagctgcgtgacggggagtatcactgaccctcttcaaacccatttcttcatcagtaaattgggataaaaataacactgactcacggggttgttttgtggattaaaggaaacatcatgcagagaatgcttagcacggggactgccacaaaaacagccccccgtaaggtatggttggttggtattgttttcccataacagacactcaggaaaccttagtcctcattattaactatcttcagatttgggatttttctcttcatctctttagggaacagaataaaaaatgaaaaataataatgaggttttgggtagacgaagggaaatgaaagcaacttttgtttataatgaatgttcaggttacaaaagtaaggaacgcagattctccggaacacaaaatcataaaatattatatttggatggtatttggctgtttacaaaagacattcacaaattacttagaatcctcaaaagaactttataaaggaggtgctattattcatatttaactgattcgttcattcaataatatttatggggtactttctatgttcccggcactggacttcatgcttgagatatacaacagtgaataaaatggatggaatccttgctctcctgccattagacaaataacacatgagtgtgtgctatggtgtgataaagcagaaaatagctgggtaagggcagtgcctgaaagaggttcaggacccagagttgcaatcttaagatcataatagtaagacccctgtggtaatttacctttgagtggagatgggaaggaagtgaggaagtcagccacctaaatagcagggaaagtgctgtctcagtggagaggtgtgttgaggaggagaaaagaggtgagtgtgactgaagctgagggagtgcaaggggcagccctaggccaccagatccgccagcaggggaaggggccagagctcaggtaaagatgaacatcgaagtagggccttgggattttgagaatacactaggcagctcttggagaattttaagcagaagagtgacacaatctaatttacatttttacaaggtattttcctggcctttgaatggagaatggactgtgtgattgatactaggtaggaggccatctgagaggctctgcgctcagggctagattggtggcagtcatggttggcttctggatttattttgaaattgagccaataggtttgttaatggatgaggaggtcaaggctgaaaataaacttatgcgagaccacacagctgaataatggtagacttcaaaccaaagccaggtggctggaatccaagctcggtgttctgttcacagcttttggccctggctctacttgttgccctgcaaacaggtcgtaaacttttataggctgggatatttgatgacagagtgttggctagaggatttgaaacctctttaagcttattttagttttagaggttatatatcctttccccatgttatttcaaaattaaatcaaaatgattgctattattgattatcggactaacccttttcacatgctttgcatatgatatttctgaacctcgtagcagcttgaaaaatagattctattattctccattggcaactgagactcagagaggttacattacttactggagaatgcaacccaggtacatttaaaaccaggaactaaacccaggaaggattaactccagagctgaagtttcgtccattttattgcatgatttctcacagggttgaccaaagacaaaactgagaaagaatttctgaagtatgtcaggactagtgtgttttataaagacttggccttcttgaatcctgggagcttctgttagcctttgtcaatacacaacaatttccatacccatgccaacaggcagatttaagcaatgtttaattacttaaataaagtatcatttatatagtctaatttcttacttttgtaatgcagtgttaattcagagccatgcatggatcagacgggataaggagaactaaatgggaggatggcgttaactctgaaagtcttaggaccctgagtggggtgtggaagtgaagagtgggattagagactcagtgctttgcagcattcctaaagagtttagcctttaaaaacttggaagagctactcatcttgctaatttgcaagaaataagtgataaattgttcaacaggattgtattagttttctaacattgctgtaacaaattaaattaccataaacttagtgtcttaaaatagtgcatgtacactattttacatttctgtaaaagtccaacacgagtcttggctaaaatcaaaatgtcagcagtgccatgtcctggaagtgcttggagagcattccttcgtttgccttttccagcttttccaggctgcccacattcctggctcccttccgccattttgaaagccagctacactgcatctctctgaccatccttccatggtcacatttccctctgaccatagccaaggagggccttctgattttcaggagctttgtgattacattgagcccacttgggtcatccagatgtaggaaataattttcctacctcaatgtccttaatcttaatcacatctgcaagtcccttttttccatgtaaagtaacaaagtcatacattctgggacttagaacgtgtacatctttcaggggctattgttttgcctacttacaggggcctttcaggaataaaggttacccaacctaacattttaagtcattccaataagtatttactggctggattttctctggtagctgctctttgggcagtggggacacactgcacaacctcacactcaggtcctgcccttagagagctcacagtcaagtgaaaaaaatcttcatttgtgactcctaggcagaaaaagatgtgtaagtcttttatttcaatatgtagtattcatgttttctagaacctaaagcttagtatagtcattatctcgtataatggagagacaatcagaaaagtagaattcgattgattattaatcttgtaatgtcctttaaactaaaaatttttgcatttgtgcccttcccttgacatttccagctaacatgttttccttcccactggatttatatatataaaatatatgttatatatatatatattatatacggatattatatataatataataatatatatttatatctatatatatactatagatatagataaagatatacacatacatagtatcatagcaagggcagggcttttagagtcagaaaagtggccaaatgttgtgggatgtgtcatccaacttctctgtaatccagtcccctcacctttaaaatggccatgtaaatgctgatccatcgagttctgagcagtgtcagtgagatcatgcatgtgccacatccagtagagtttttggtccttaaatgcatcagaaatgttaggtattcttttttttcttccttttctttttcttcacttttattttaaagtctctctccatcacccagtctggagtgcagtggcgagatcttggctcactgtaacctccacctcctgggttcaagtgattctcctgcctagcctcccaactagctggggttacaggagtgcaccaccacacctggctgatttttgtatttttagtggagacagggttttgccgtgttggctaggctggtcttgaactcctgacttcaagtgatccatctgcctcagcctcccaaagtgctgggattacaggtatgagccaccatgcccagcctcatgttaggtattctcatttccaaaagatattcccagaattatacttggatcaggagtggggaaggttttattgccccaaagtagaaaatctggccctttttctcaagaagagtttagtcttcctgggaaaatgaaatatacaagcaatgtacatgaagtggttaaatagtgaagcaaggcaaatgaaatcaatggtgcagatcagaaaactgtagagaggcagagaactgaaacgggaacaaaagcgtcaagggggaaaatagcagccagtactggtagctagggagatcgtgatgtgttgaccatgtgacttgtgccaggcagcatcagtgtctaaattcagaagagtaacagagtgtcacttcatcataggtcttgaatgcctaaaggataatccagaatagtgccatgagtataggtatggaaattctgggaggtccagatgagcagatattttgttgctaaatattaacttgaaagataattgaaaattcacatggatctggaaagaaaagtccatagttgatgttcagaaaacctaaagaattggcttcaatgaactattagtcaccctaaactggtttgaaaatataaatactgtgtgacacatttaataaatggtgtataaatattttatgtcctgttccttatcaaactgacattctttaatctctttcagatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtgggtgagtgtgcctgggagctgacttaacatgctattttcctaaggaaagtggtcaaggtcatgttcagaagtgtattaactcttgacacataatatatggagggaaaaatcaaactacttttcaccatacatttgagttttagacttcacactgaaattgtactttcttttttttttttattatactttaagttttagggtacatgtgcacaatgtgcaggttagttacatatgtatacatgtgccatgctggtgcgctgcacccactaactcgtcatctagcattaggtatatctcccgatgctatcccgccccccctccccccaccccacaacagtccccagagtgtgatgttccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatagatggacatttgggttggttccaagtctttgctattgtgaataatgccgcaaaaaacatacgtgtgcaggtgtctttatagcagcatgatttatctttgacaaacctgagaaaaacaagcaatggggaaaggaatccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccagaagcaatggcaacaaaagacaaaattgacaaatgggatctaattaaaccaaagagcttctgcacagcaaaggaaactaccatcagagtgaacaggcaacctacaaaatgggagaaaatttttgcaacctactcatctgacaaagggctaatatccagaatctacaatgaactcaaacaaatttacaagaaattgtactttcaaaaatgtattgaattgggatacttctataattcaaaacagacaccataatattctgctgttttctgtttgtattcgtatgactaggacatagaaaaatttaatttgcatatctttcttccacaaaagtttaaaactgcgtttatgttattttcaaatagatgtccgtccattgatacaaaccaaagatggagaaaattacgctacagtggttgggtacagtgctttcttacattgcgagttctttgcttcacctgaggcagtcgtgtcctggtaagccggtggctcatggttttcttaagagaatgtcaattgtagatttgaccttgtttcttcatccgtcatttgacaggctgtattgtgtctatattgttacatgtacccagtacctctgagacataaggtaacaaacttaccggtccaggaaattagctctactgaaagcattggctagatttctaggattttctcacatagagacatacagagagccacttgtgttcataaagaaaagcagagaattgaagagattacagagacaattttaaaggtagttttggtttttcattatgaggtaccacaaggtcatgttttactctattgttgttgttttgggattatctaaatgattatctaagctcgaatttaattccaaatgcatgtgcttaagacttttccagcattcattttgattttaatttcaatgaattaattggtatcataagtccaaagacattatcaatatggatctaccttattagttgctttactgaaaaagcttggttaaatagttcttgaataattttgtcattggtctgtagggcagtgtgagatgagtgaccccaggtcataaatttatagggtcagatattgcctttattttaaatcatgatacgtattttgttcatcgtgggttttttgcattattgtgatttttcaaaatactagattgaaatattatttaccttgcttactgagatgtttggcaccctgttaaattttgcatctggggcaagcctcccacttgcctcagcctagtccctgtcctgtatgatcctacatggaccgcatccacagcttatccttaaaaaaaaaaaagaaactcaagcagtcgcttattgtcaaatgtacagggtaaatcaagctgtagcagcaagggcttggaaatggctgaatgttggaggaaatggctctggggttgatagggtaaatgtaatccatgtccacaggacaggcaagactccccagcttataatatttctgaatgaccaatgttctcccaggacagcaggaggtttgaaaggttcattatctctttcaattactagctttcccatttagtaccctggagcaatcattaactaaagagttcaccatcaataagccagaaaatatttattaagctctgaggacacatgcaaaccggtgctggtggctatgacaaatacagcagaagcactgagcatggacttggattttctatagccacagtctatttgggtagataagatatacaatcttggtccattttgagaaaaatatgaaacccactggaacatttcatgaggttttctgagctattgaaaggggattagcctgaatgacgtcactgactagtattaaaaagcgtatacaattttgccctacctcagatggatgtacgctttctttgtccataggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaagtatttttatttcactgttactttgcatgaattgtcacatgggttcagtctgtcttcatttgcccaaatggaataataccatttaagttggagtaccagataaagttctttgaaccgtttttcaaaattcctagaatgggtttcatctaaaagattattgcaagaactacagggtatgcccatgatatgtgcacagcttcatcctattttaagaggcagccaggtgtctgtagtgacagatggctgtcaatatttaaaaattacctattaaccatactacaccatatttctgtaactatattttatttccaaagctaactcaaggtaatggtaacagtaatcaagtttttgagctaaagatttcacaaactcataactttataatgactgaggcatgacagaatgaggagggtttttgatcctctttttgagtcataaacagctttgtattattccttctcacttcagggcacagtcctgggagctgttaatagtttcttgggcttcactgatattttgattttaatattgctcagagaatcttcaagaaaacacaaaatggaaaggatcttcggtattaataaggagcatttttgtttcttctgtcgtgtccatatcccagcctgcttctcacttccacctagataagggagagcatatttgtttgatcatctgttttcactgatgccacttttcctcatacatatctgctgttgtatccactgatgtcttgacatttctttctctcttcccatatatatccttccttccttcttttttcatcctgttttccttttcttttgctgtacatccttttcttattttatagcatttgtctctttctgtgccctgagtaaatcagtgtgccagccccacagactatatttttaaagcactcaaatactctcccacaatatctacttatctctgatgtcttttacattttcaagtgtcatgtacacttttcaagatgccctcatgaagtcactgaagatggtgatgattgtttttatacttcaaaaagtaaacctatatcaaggttaagcaactcagctaggtgtaaggagcgtgaagcctcgaatccaaatggaactttgcactcctattgcccaatacagtgcttggcccaaaatggacctcaaaactgctagtggccagagagatggacaagtttagaaagtttcaatatgctgtagtgtctattttatatgttaaaaatatatacgaatcgtatcaatggaggattaaggacacttttttttttacatatacaaaaggcatgttgagaatggagttaagtgagagcctatatagtatagtgattgagagcatgagctttagtctcaggcagatttgggttcaaatcctggttcagcccattcccggttaggaaaccttgtcttatggctcaatttcattttagccttaaattattttctctgtaaggtgggagtattaatattcataaagttgttataattataaaatgccacaatgaatatgcattacttagcagagccctgatagagaagtgtttattaaattgtatctattattattaaatgaatttctggctttaaatttagaattagaagtaggatgtcaaataattcacttaaaattaattcaatttaatagtctcttcaagttttgtgcctggaataacaattaattttattaatactttccatttttagccagttccttgagaaaaatgtacatagccaatatcagagtataattatagaattggaggtcagcttgtgcagttggtctctgggaggtccccaaaatgccaaatgccacattaagagtatacttacttttaatagggcattaaagagtaaggattgcacgttttgaaacaatcataatgaaccaaacattttcttaaggcagccataaaccaatctttgagtttcataatgttgataactacaaatttatttttgtttcaaactatcactccctgtaattcattcaaaaggagacttaacactatgtattgaatgcctacggtgtacaggctcccttctaggctctggagacactgcagtgtcatgaaacagtcacaggccctacttccctgaggcttgctttctagttccccaccttcatgttaatagttcatccattcatgggcttaaacatttaccctcaggtttctgaattaataataaacaccctaacagaaaatcaaatatctttcccttttcctttacagtgctttgattatatatccagaagcacttgaaggagaaattatgttattttcaacttctagagacatttgtttgcttatactttgcttactcccttccccaagaaataatgagggaaattcctaaactattagttgatatttccacttaaattttgtcagatgtccaagcctggatggaaagaaaataataatgacatacaatgttaggaaattacagtgggacaaaccctgcatgaggattggacagttatggtgacaatttgggttacttaacttgcaggcacttaataacaaagtaagttacgcttagttctaactaatatctttgtttggtaaaaacagatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggtaggtaaactattatgatatgtcataatatttgcttggggtaaacaacttgcatttgatttaaaaagttctaggtcgggcatgctgactcacgcttgtaatcccagcactttgggagaccgaggcgagtggatcacttgaggtcaggagttcgagactagcctgaccaacacggtgaaaccccgtctccactaaaaatacaaaaattagccgggcatgatggcacgtgcctgtgatcccagctactcgagaggctggtgcacaagaatcacttgaactcaggaggcggaggttgtggtgagctgagatcacaccactgtactccagcctgggggacagagagagactctgtctcaaaaaaaaaaaaaaagttcttaaagcattcatacagaaacaaaaacaaaaactgagtaatatttctgtcttcaagtcacttcactctgctatcatatgtttatcatcctgtttttgctactgacttttcatgtaacatgtaccattctattagtgtgtgaaatggaaaccactctaagtaaccgaggaagaattgcatgggcttggatggttgcaaaaaaaaaaaaaaaaaactggaggagctaggcctagaagaggctgcatactagtcttctaggttcttgatcacaaagcactgcagctgcaatccaggtgtctggaaactgctgccatcttcatggccacctcaccccattggtactactcgtgagtcctgccactgccacctctcatgtctgccagaaccactgtctgctcccactggcccagagaagatggcatccattttccttctacttttcaatctcacatgagtttatttaactcactagcaaaacctaaatcatatctgggattcttcctgccagagagtactgagaagtacacctttgagtcttccaaactctgtatagagaatatagacaaaatataaaagagaacatatagaggaaagtgtgaatggatgcttaatagcactagatgatattaagtacatcaaagaaataaaaagtcagcatttgctgaatgtctactctcttttgaaaatatgagaaagtcagcttcgcgtccttttgcattgttactaagtaagggttaaaacttaaccatcttggagccaaatctcccctctcattaattttgtaatttattaccctgtaaaactacaaatctgaaaatgtttagataggacatgtgctgcttgcatgagacagcaacactgccatgggtaagatcatgaactctgaagctcaatggctcagattcaaatctcagctcagtcacttattagatctttgaacttagacaagctgcttaacatctttgtgctttagttttaaatcccataacatagtttgaattaaaagtattaaaaaggtactttcattatagggttaacaataccaagtacttagaaaacattaacatacagagcacttagaaaataccaactgcacagtccatttttgcttttgtgatttgtactgctaatttcttcatttttttccttatgacaaatttctttttttaatttttgtttttctttacatcttcattaaaaaatgggatacatgaacagaacatgcagatttgttacataggtatacatgtgccatgatggtttgctgcacctattgacctgtcctctaagttccctccccttgccctccacaccccaaaagtccctggtatgtgtgattcacctctctgtgtccatatgttctcattgttcttctcccacatgtttgctgatgatgatggcttccagcttcatccatgtccctgaaaaggacatgatctcattcctttttatggctgtatagtattccatggtgtatctgtaccacattttctttatccagcctaccactgatgggccttggtatcggtttcatgtctttactattgtaaatagtgctgcaataaacatatatgtgtatgtgtctttatagtagaatgatatatattctgttgggtatataccaagtaatgtgattgctgggtcaaatggtatttctggttctagatccttgaggaatcaccacactgtcttccacaacggttgaactaatttacattcccaccaacagtgtaaaagtgttcctttttctctgcagcctcaccagcatctgttgtttcttgactttttaataattgccattctgactggcatgagatggtatctcattgtggttttcatttgcatctctctgatgatcggtcatgttgagctttttttcatatgtttgttggccatgtaaatgtcttcttttgagaagtgtctgttcatatcctttgcccatgtttgatggggttgtttgtttcttataaatatgtttaagttccttttaaattaagaatattagacctttgtcagatgggtagttgtaaaaattttctgtcattctgtaggttgcctgttcgctctgatgatagtttcttttgctgtgcagaagtgctttagtttgattagatcccatttgtaaattctggcttttgtttcaattgcttttgccattttcatcatgaagtctttgcccatgcctatgtactgaatggtactgcctaggttttcttctagggtttttaatggttttgggttttatatttaagtctttaattcatcttgaattaatttttgtttaatgtgtaaggaaggggtttactttcagttgtttgcacatggctagccagttttcccagcaccatttgttgaataggagatcctttccccagcgcttcgatttgtcagttttgtcaaagatcagatgattatagatgtgtggtgttatttttgaggtctctgttctgctccatttgtctatatgtctgttttcataccagtaccatgctgttttggttactgtcgccttgtagtgtagtttgaagtcaggtagcgtgatgcctccagctttgttctttttgcttaggattgttttgtctatatggggtcttctttgattccatatgaaatttaaagtagttttttttctaattctgtgtagaatgtcaatggtagtttgatgggaatagcattgaatctataaattactttgggcagtgtggccattttcgtgatatttattctttgtatccatgaggatgggatttttttttttcatttgtttatgtccttttttatttccttgagcagtggtttgtagttctccttgaagaggtcctttgcatcccttgttagctgtattcctaggtatttgattctctttgtagcaattgtgaatgggagttcatttatgatttggctctctgctggtctattgctggtgtaaaggaatgcttgtgatttttgcacattgattttgtatcctgagacattgctaaaattgcttatcagttcaaggagttttggggcttagacaacggggttttctaaatataaaatcatgtcatctgcaaacagacaatttgacttcctctcttcctatatgaataccctttatttttttcttttgcctgatggccctggccagaacttccaatactatgttgaataggagtggtgagagagggcatccttgtcttgtactagtttgccaagggaatgcttccagcttttgccaattcaatatgatattggctgtgggtttatcataaatagctcttattattttgagatgtgttccatcaataactagttaattgacagtttttaacatgaaggaatgatgaattttatcaaaggccttttctgcatctattgagataatcatgtggattttgtctttggttctgtttatgtgatgaattacatttattgatctgaatatgttgaatcagccttgaatcccagagatgaagctgacttgttcatggtggataagttttttgatgtgctgctggatttggtctgccagtattttattgaggatttttgcatcaatgttcatcagtgatgttggcctgaatgttcctttttttgtgtgtctcttcctggttttggtatcaggatgatgctggcttcacaaaattatttagggacgagtcccttcttttcaattgtgtggaatagttttagaaggaatggtatcagctcctctttgtacttctggtagaattcggctgtcaatccatctggtcctgggctttattggctggtagactattaattactgcctcaatttcagaatttgttattgctctattcagggattcaacttcttctggatttagtattgggagggtgtatgtgtccaagaatatgtccatttcttctagattttctagtttatttgcatagaggtgtttatagtattctttgatggtagtttgcatttctgtggggtcagtggtgatgtcccctttatcattttttattgtgtctatttgatacttctctcttttcttctttatcagtctagctagtcatctatctattttgttaattttttcaaaaaaaaaaaaccagctcctggattcatttatttttttggagggtttttcatatctctgtctccttcaattctgctctgattttagttgtttctcttgtcttctgctagctcttggattagtttgctcttgcctctctggttcttttaattgtgatgttagcatgtgaatttgagatctttctagctttctgatgtgggcatttagtgctataaatttccctcttaacactgctttagctgtgtcccacagactctgatacattgtgtctttgttctcattggtttcaaacttcttaatttctgccttaatttcattatttacctaggagtcattcaggagcaagtttatcaatttccatgtagttgtgtggttttgcgtgagtttcttaatcctgagttctaatttgattgcattgtggtctgagagacggtttgttataatttacggttttttgtatttgctgaggagtgttttacttcaaattatgtggtgggttttagaataagggtgatgtggtgctgagaagaatgtatattctgttgatttggggtggagagttctgtagatgtctattaggtctgcttggtccagagctgggttcaagttctgaatatctttgttaattttctgtctcattgatctgtctaatattgacagtgggttgttaaagtctcccactattattgtgtgggagtctcagtgtctttgtatgtgtctctaagaacttgttttatgaatctgggtgctcctgtattggatgcatatatatttagaatagttaactcttctggttgaattgttccctttaccactatgtaatgcccttctttgtcttttctgatctttgttggttttaagtttgttttgtcagagactaggattgcaatccctgctttgttttgctttccatttgcttggtaaattttcctccatccctttattttgaatctatgtgtgtctttgcatgtgagatgggtctcctgaatacagcacacagatgagtcttgtctccttatctgatttgccagtctgtgacttttaatttggctactcagtgcatttacatttaaggttagtattgttatgtgtgaatttgatcctgtcatcatgatgctgtttggtcattttgctcattagttggtgaagtttcttcatcatgtcattggtctttatattttggtgtgtttttgcatgactggttctggtttttcctttccatatttagtgctttttttcgggagatcttgcaaggcaggcctggtggtaatgaaatctctcagcatttgcttgtctggaaaggattttatttctccttcacttgtgaagcttagtttgacaggatatgaaattctgggctgaaaattcttttctttaagaatattgaatattggcctccactctcttctggcttgtagagtttcttctgagaggtccaccgttagtctgatgggtttccctttgtaggtgacctggcctttctctctggctgccctgagcattttttccttcatttcagccttagagaatctgatgattatgtgtcttagggttaatcttctcatggagtatcttagtggtgtactctgtatttccttaatttgcatgttggcctgtcttgctaggtttgggaagttctcctggataatatccggaagtgtgtttttcagcttgtttccattctacccatctccttcaggtactccaaccagttgcaggttcagtctttttatgaagtcccgtatttcttgaaggctttgttcattcctttgcattcttttttctctagtcttgtctgcacactgtatttcagcaaagtggtcttcaaaatctcatgtcctttcttccacttggtagctttggctactgatacttgtgtatgcttcatgaagttctcctgctgtgtttttcagctccatcaggtcatttatattcctctctgaaatggttattctagttagcagctcctgtgaccttttatcaaggttcttagcttccttgcattgggttagaacattctcctttaggtcagcatagttttttattacccatcctctgaagcctactcctgtcaattcatctgcctcatcctccatccagttctgcgcccttggtggagagacattgtgatcactgggaggagaggggtttttagcattttttttgttgattctttctcatcttcataaatttgtcttccttctatctttgaggctgctgacacttggatggggttttttgtgggagattttgttgttgatgctgttgttgttgctttcttttctttcttttttttttttctttcaatggtcaggtctaccttctgtagggctgctgcagtttgctgggggtccacttcagtccctattcatctggttcacgcctatgcctggagatgtcactcaaggaggctggagaacagccaagatgggtgcctgctccttcttgtgggatctcagacctcaaaggtcaccaacctgttggcagtaggatcactcctatatagggtgtctgacaagccctcttggagggtctcacccagttgggtggcacggggaataggacccatctaataaagcactttgtcccttggtggaggggatgtgcttcactagggggaaaccgacttgtctgggctgcctggattcctcagaactaccaggaggagacgctaagtctgctggtctgcagagaccatggccacccctccccctaggggctcaggcccagggagatctggattctgtccctgagcctctggctggagttattggagttcctgcagggaagccccacccaaggaggaatgatgggtcagggtcaggcctgaaaaggcactcagggtcaggcctgaagaggcattgattctgccacagtgggtgtgttgggctgtgggggacgtgtcttgggaccaagccatccagcctccctggctccagcaggggagaaagcacagcctggagctacagatatgaatgttgcctctcccccacccagggagcttagcgtgttaggcagttgtgattcccagtgctggctgctgcccctcttctaaggagctcaaatggcttaggaagcaggcagctgcagctgtggggctggccgcccctccaccaggagctcggtaggcttaagcagattccagctgaaaggctgttgagaatctgtggggcttcggggttgtgatgctagacccagtggctggagtttgtgagtggggtcttccaatccatgggtttcacagttctgtggaaaaagctgggtagcacattcactcaccgcctcccttggctggggggaagggtctcccctgccccgtgcggctctcaggtggaccactgcaccacactgttcttccctcctctccgcggatcatgccagcctcctagtcagttcttctaagagaaacctggataccttggttgccagggaaggattcacacacttactatagttcttttccatgggagcctccgaacacagctgtttctagttcgctatcttggtcctgctccctgcctccgcctcccccagcccccaccgccccactgccttcatttcttcatctgcttgtctcatttctgttgcttgcttggtctatgttggtatttatgtgtgagccgcctctatgcaaaggcattggtctcagccttggttcttgatttattctctcccctccttccgatatatacaaaggtttgcagaaaggcagtgtatgtattacaaccagttctcattgaaacacgagattaattatatacctctaaaggctacgctttgcaatacagatctccagcctcaggttaggtctccgctgatctgccaactgctcagatatgcctaaattctgcctcttttgttactactgcctgactatccggggtcttccatgtgacctctgggctacagccaagaagggaatcagagacccatggctggtgggtaatatgacatggacatttaggctttgaccccagaagccctaagcaaccttttcatgtgacccagttttacagttcctgcaggatcccagagctgacactgaaatgaacctctggctatctgagtggactgagcaagtgacacagatgttctgccaatttccctaaacaagtaacagggataaaggacaataaccttagctcagaagaggccccaggagcaaggaagcctgggagtaactgctgctggctggccttgactgctgccaagggcatgcacggtgatatagcagggagtagaagtcacaggtatctgctaattttctacaaagccatatcagtaacctcatacttcttaccttctgctgagacaccttctccttattactatgcagaagaccggaagctttaacctaaagggaggttaaacttctaatcaaatatacatggtgaacaatgagaagtgaaaattccttcttctcttctcgcttgtcccctttcttgtgtagggatgcagtaagtgctgggaactgccactctgaaccattagacctacggggcttcatgttatgttagtacttcccatacatgctttctctctttaggcctcccaataatactattaggtagattgaaatgcccccccaggaattttctgtggatttcctacctgcaggtggccatagaccatacaggctatagaccatacactatggttatgaaaaatgaaatggagcatggctatgaaaccatttttagaatttatatcgtgcttaacaaaggtaatggggactgttcatgactgtaggcaaagggagggacctagtcctgtgggagagaccactgtagcatgaaaagtgggatatactgataactaggagggcgtgggaggaaagggcattgagaatccagtgggagggtttttccttggcaccaaataggagctgcttttttccccctccagaaatagtggcaaattaatgagggaaggggagaagttgaagatgcaaagatgaagatgcagtcatagtgaaaggtctctttctaacaaattaggaaataaggtaatttgttcaagcagagaggcaggagaaatgggagttggggacattaaaacaccaaccatgagaaatgtgattagcaataagccaaaaatgaatgaaatcaacttgattaatattattagtaacactctctgagcacatactctgccaggctgtatgcactaatcactttatgtgctttacctcatttaattctcctaaagagaaagaaaatattgttatccccatttttcagataagatgaattaggctcaatgttttgttcaaggttgtacaaataataattgatggaactgagccgcaaacacaggtctccaaagagagaatcgttttgtcatagtgccttcagggaaacacggatattactcagctgaacagggtaagacaacaatggctgctgacatggattagggactagcagactggataccgcagatgaaggagtcgagtggttttagtggatagatttctcaggcaaggtaattaagcagatgaaggcaaacagaggaaaagattggggcacgaagatgtgaagaggtttttagcttcttctaagagttcaagtgttatgagagtagaaatgatacaactttttaaagcagaatcccagctgacctatgatgggaacataatgtgagggaggaataagtgactgttttcttgggcatggggaatttggagctgtctgttactgcagcacaccatagtgtgaccccgtgtgtgattttctgtgtgaccctatgtgtgacaactatttgtgattttgacatgtgacagaattatccaggcttcatgttcaaatgcaatggcccttgccccatctccaaatgtactgatttggaacctggactgaggctggaacacgacatttttaataagttctttaggtataccatacctaccacatttcgaggactagtgaggcacccaacgttgattaattggaggcacctaagatacatttgtgagactggaaacaaggcatagtgcaaccatgacttgccaaaaaaattggtagctttcttctctggcctgaaacaccccgtgccagggtataaatcttggcaagatttcagctactatgggccctcgtgcagggcacagaagtcctatttcaagaggttattaaagtatattctttcatctaagaaggtacatttttcaaaaattgtcaggatatgcagtattctaatattgtatcaaatggacacctgagtaacatgacctgacatgttaattcatgtcaaagttttattatgtctagaattatggtgagattcttgattaacaattcaaggtaatattggttggcaaatctttctattattggtgtaggaataagggctgattctgtctataatcaaaataactatgtttcattacactgcaatttaaagtaggtttatataattcaaaattctcagcattttatatgaaatgtacataaaaatattaattatgtgagcctcctttcctcctcacaaggatgacactatttaagttatttcaacaaaatgctaattattatgaatacattttaaattttacggaacttgaaaaatactttaatagttatctcaacaatggtacggggtaaaaggtgaagtttataaagaagcagttttctcatagtaaacctgatcacaaattggtaaaaacaaatgataaaaagtgaggtgaaatgatttgcaaaaagaagtactacactgccatcttctgttcaaataagtcatatgcttcaattgctatctgatcttaatgtgcattgtacttgggagtggaggggcggagaaaagagaaacttgtgaaaaactgagattatccgactccttctcaggtattctggttctgtggaatggagatggaattcaggaatctgcctttgtaggaagcactccaatcgagcctatataggtgattccctaaacataccttaagaattactcaaatatatcttggccattgtgaggtatgatgcactctttaaacatgccaggcaacatacagttccatcactgacccatgcaaacagatggttagatttcataatttttaatgtgattttgtttatggctatgtagacagttgtgtatgctagaataattctttatctccaggtttcaactgtggcattctctaatcaaatttgcattgcataaagtcatctttcactcttagattgttttcgataaggaatatgcatttttaaaagaattgggtttctatcatttctattgttttccttctcatcatgtactcactttttttctgataggataattattgatggagctaatttgaccatatctaatgtaactttagaggaccaaggtatttactgctgttcagctcatactgctctagacagtgctgccgatataactcaagtaactgttcttggtaagtgcactaactaatgagaaatctgttcatttcttcatttctgattaaatcccatcgttcctggccaataaagctaatgattctttgagcccctgcacatatattgttagtttcaaatttttgtttaaaaagcaacacaacttcaaatcctttctccttttttcatataaaagaaattaattaatgcttaattttttttccctacatgtgttaatttgccaatagcagtgggaggtaagtgatgctatccgcagaaagaaaaataaagcacgcttgagttcctagcactcttgagctactctttcctggtgtacaaagaaatggggctgaggaatggaggtgggctagactggaggatctcgataggggtcaagaggtggatgcacggtggtcatctctaaaccaaaggcacagactgagttcccagggttccaggaaggatggagaggaacttccagcattctacaaaggaatgtctttgatttttgtcgttgttgttgttgatgaaagtactaatcaggaaacagtgtgcacacttcactagtataatcaatgcaattactcctgaaatcaccaatgtttaaagctcttagaccatctgctggatgttttccaaaatttcccttccagattcactctctaccagctctttgacctagaaaggttgcttttaaggacaacatcagcaaaccactttccttccagctattatttggttcagcaagtggagggccgtttggagtgttgtactgattctccctactccatccctgtggactggctgtgtcccactgccaaagtcatggcttctgcagacagggtctcctcacaccattccttctgatgaggctctagcagctgcatcccaccaccaatatttcaagtctctctcacacccaacctactgaacatcctgcccacatctttttaaagacgttttattaaaacattttggaactatcgtaaatttgtgtgagttattcattgattttctgcagggaccctaacagctacagacatttgttctgtttcggtggccaccatgtagtctttcttttagtttgcagacattccttaaaagtgttggttttgcctacccttctttatcatatgtctacattaatcactgttatcaacagacctttgtgtctttagcactccagctgttggggccacctgttaggttccaaacaagggaggtggtggtacagaccaagggagaaagttcagtctcttctgagagactgataaaaaaatgggtcaacaggctggatcccttcaagtaaagcaaatggccaacctgtctcgggcgaaacaaatggccatcaaggttgggttctaaaataaaagaacagtttccacttacagaaggtatggacttgtagagttgtcgagtcggctcagtagaattgtacctttaggcagaatgtttggccattgggtatttgagcattttcaggtctttacaagcagaaaggtttaatcccctaggatgatttcaacaataattcatcagataaagtagtcgagcttcagataaactggaattcatcccaggcctagtgagtagaggggtaagtgtcaggctccgtgcgctttgtccctaagtattttgagcagtctcagccaccaaaaggaccgggtctcctactgcttggtgctccccttctcaatttccttacaaaatttaaaagttcattcttgcgattaggctgccatttttggaactattaatttttttaattctacataaattttacctacgattatatgtactggttatatacgcagtaatctaccagtgtttacagaataaaaataaaaataaattttggagaatattatgtttaaaatttacattcttttattttttagacaaacttctgatttaccaaagcatctctcgacaattgacaataaaaaaataattatatagacacatacgaggtttctaaaagactatgttttaccccctggaaaacaattttttaaagtacatacttgaccccctttaatcaaaagttatttttaaaagccttgacataaacatgctttcaggatatcattttttaaaagtttcagttgcaagttcatcagttctagctccatacgattctcagaagagccagattttaatatcagatgcaatacacagccttagtttattccaggaagcttcagaaatcagtggactcagtaaatactgaagagaaaccaaagtcctctgagctcagagattctgaaacctgttgaagaattaactttttatttatggctttaatgtttggacacagtcatgaaccacattttttaaaaaacatgttctctcttctgaattggaaacgatgctttttgtcaatgtaaatttctaacaattagcaaatattcaggaggagcaatggacggtgctttccacttggagaagaaagagcccattgaaaggctacattagataatatcttccttttctcttctgctaaaagataaaagtcctccaatgcttgagagaattcaaacccaattttcagagtaaataccattagaaataagatttctttttactgttgctttattttcaaagtaccagaaattttcattttctttagtactcaaaaatttgtgatcatttacttacttaattttccagtttctgtcacaacatttaacaatgccaaatctccctgttctgatataaactgccttcctactctttttgagaactccaggttaagacggtatcaaagttgctataatgaaaattcattgttatcaataatgataaaaatccaacacagttgcagaaaagaaagcagagctcatgatctctttttctataaccataagacctaatgtttattgctttaatataataattatacacatgattgaagtaataatatctttttcactgatttatttagttataaaacatttatgtgtgaggcactgtgggcaatgcaaagcttaataaaatatgacccctattcttggagatgaatcaggcatataaacaaatatgtactggacaaacagaaatgattcatttgagatacatcatgtttcccagacttgggtatacctaatccccatccaaggaacttgtttgcaaatgcagattcctgggcccaccttcctcagtaagccagaaatagggcctaggaattttcattgttattaactactcctaaaagaattctgatgtccctggtcaaggataaccccttgagactgtaatcagagaagagggaggtaatatggtccattggggaggacatgtggagatgctgcattttacaaagaaccccagaccccagagcctgatgcgattgaacacagtggagacatgggcccagaaaagaagggtttttatggaaccaaactggggtccaccaacccagtgcagtaagaccaggtatctatactgaggtttgcagtgggagaaaggaagacacttatctgcagggcaccaaacaagaactggtcagctcatgcttaagtcccaacctccccagtggcttgcaggtgaaggtatttaaaagcaggagtaaatttcaggagagcaaatgctataggcaaaatagtaaattagtacattgaggttacacattgctttatgcctaaaagggtgaggtatcttgaactggagttggggcatggcttacaggtcataggtggattcaaagattttctgatttgcaattggttaaggaagagaagctttgtttaaaaattgggagtcagccaaaaagaatattagctctggctcatggatgtggctccctttaggccctcaggaagaaatttacaaaaaatgatggtcagaactcagacttcagtttccccttatctgaggtctccatgccagcaaagttatttggtgagagtctgggttccagaaaaacaacttagagacatatattaagatgttatcttcagtttctataggagaaccaaacatccctgtgattccagcttccttggctattgtttaaagctactattacctccgttcttatcaagttgtttatttacttcttagggctagctaggtgcctgaattacccttgaaactccacctttcccttccatatgtggggtggggggcgggggtgcttcccaggtccctaagagggtggtacctcctctgtctccgggtagctggcaatgtgtctgaggaagggaatcaggtaaacaaaggcaattatctacattttcccttcctttattaattagatgttccggatccaccagaaaaccttcacttgtctgaaagacagaacaggagtgttcggctgacctgggaagctggagctgaccacaacagcaatattagcggtaggaagacttgggataactgttttcattactctagatagtcaaaattaatagcgaagtcactttttaaccactcttactggtttattcttcttataacatccttttgaacttttaatattgagtataaattttggtataacttatccatactccatacattctaatattttttccctgtttatactaccagagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcaggtatgcaggttctcacatcaggtttctaacaaaatatttgtttgtccccatctttgaacatctaaaaaaaaaagattgatagagtaatgtaggattttagatttctccaaatagtgttaacagttctctaaacagcacacaaaatattcaaagcacacaagtttcagaagtgttacatacgagttcgataaaagcaggaaattaggggagtgacatatgaaaaaaaaacattactttcagtaattttgtgatggctaaatatcaagtttaaccagatatcatcaagtaagttctaaattaaaattcaatatgtatgcatctaacattattaatttttatgcattcagtgtcttttcttgtgtctcaacatcaatctaaatttccaagatgcgtttgaaaaaatctcaaggatgactgctaaaatttgtattactgaattgttattgatcatcaatgtggtcatagcatgatattttatttttccttggctaaaataaatactctaggacataatttcctttttggactgagaaaaagcaagtgaaggttataactggatcagatagaaattaacacttgtgtgattttagtgcatgtcaacctttgcactaaactccacatttagctatttctaataaaacgaatccatctaaaaatattcatgactactgtacaggttttattcattttgatgtccttaaaacttggctgctgatattaatacatggtgtttactttattcttctacaggcaaatattcacaacatatgtttctaatgacaattctaatagaaaaaatagagcaggcttaaattaaaatttttttttaaaaaagcaggttcagaattttaaaaagcagttttaaaaattttaaaagcagattcaaaattaagacacatatactaaaccatctactctccactggataataattatttcactccaagaagactgttttactcttttaaataaaatacatatttaaaatctaccttaaatctttttaggaactggaccagatataaattaataagtacaatcaaacttacttaattatctgtgtttttggggggcaggagttgtgatatgatgacttacctatgggttaaaaggaaaaataatgttaatgtttttaatttttcagctccagataggaatccacaaaacataagggttcaagcctctcaacccaaggaaatgattataaagtgggaggtgtgtatttcttaatacgttatgtatttctttgtgcttttctcttcctcttaggtctgcatgctaactacaatgatagcacaacatttttttaagaacaaagataagatttggaaatgaaattaacttgtgagtcatcatcacaaattttaaagatcattgtgattaaaatgatgttatgaaatcgagtttaacactggtcaacaatttagggaagattatacagattgatttagttgtaatacattaccgaagtttcaaattattaataatttaattaacaatattctagattctcttccattcaaaaaatactgaaaatctttaattaatttagtataatctactagatattatgcatatcaaactgatgaacccccataaagtattcactactcattaaacaccagtagacattttgtattctcctttctagtaattctgaggatggtcttgtgaagaaagcatcatgaacgccttattctagatctggagatggcatccaggattatgaatgtcttgcccatcaccacacaaccagaaatccgcaaagctaggatttatgtatgaggatctttggactccaaacctcactttttcctcctttacatatctcggttaaatgttattaaatagacttcaccatttgaattttgcataaaaatgcccatctacccagataattttaattattctagggtcatttccaaattttttctgtaacagtggggcattttattttctctctactacttggatgtatttaatgaccagtatattggcctacctaaaaggaaattatcattcaaccattctgatgagtaataggcctccaacattgaatttataaaattttgtgtaaacatagaacatttttaatgtatgctgaaatatactaatttatttccacaattcattccaggtataatttttgggagaattttagaatgcacaaagtttagtttgctttttatcctcatatgttggtctttgtactcattacacaatcacatggcccatacctgcaaaatatttagtcaatattttttagatcaaaattagatctttatttccacttcagtgaaattaagttttacaagtttaagatgtggaaaactttttttaaaatggtaatacatagaaatgaaatatattcaataatattatttctttccttgaatgtgtggttatagttactactacattgtcttgataattacttaatttatagtctaaaatgatgttagtcttttagggtgtatctgtattatcctcccttaagttccatagaaattttcataaagtagataatatagttggttagatatcagtaatactgtgtatttgccagtcagttcctcagagaagcacatcatgttccagtaacattagctcattaatcctcactactcctttgggagggctgtggtccatgatggtgtcagtcttatatgtcataaagagaaactgggaatctcagagtttaatgacctcacccagatgccatgggctgagtcatatggaaaaaaggccagaaatcttcagtctttttgactgctcctctcactcataagtcattttttattaccccaaagatacacaagattgattattaatgctctcttcttgtaagaatgggactgtactaagaaagcatctatggccaggtgctgtggctcatgcctgtaatcccagcactttgggaggccaaggcgggcagatcacaagatcaggagtttgagaccagcctggacaatatggtgaaactgcatctctactaaaaatataaaaattagccaggtgtggtggcacatacctgtaatccctgctacttgggaggctgaggcagaaaaatatcttgaacccgggaggtggaggttacagtgagttgagatcatgccactacgctccagcctgggtgacagagcgagactctgtctcaaaaaaaaaaaaaaaaaagcatttaaaattggtctttgaggagcaaacgacatgtcatttagtaattaattgactagaggaaggaagtagtcacaggatttggatctaggctgacagttacattcccaatatgtcccatggtgtctcctattatcttgatgtgtcagagatctaatcactactgacacagccagtgaagtttaagaacattcattcactgagtatggttctgtatggatcatcctgcggaaaggagttagactccaggtttttcccagtttcacaatcagatagtattgtgaatgaattaccagaccccctccagagatgtactagaaataattcctatctacatgataatggtcagagggacataatttgaaaaaaaaaaaaaaaaagctgatctttcccaaaagaattaacaatgaagatgagcagtaggaacagactggacatccctaatttttgtttatttgtttatgttttacatttaacattaaacatgattcaatttaaagtaacattacaatttaacttaatggtagaactaggctttttagttagcattaccttcagacattcacttctcatatattaagtcggtcatgactcactcatatattttgagtgttcgaacatcataatgttctacttgcaaaacaggacaaaagagtctactgcaaccttatcagttaaatacctgtatcaggataatttttgcttgagagtttccattgttcttaagcatatgtatgtgaatttttaactttgctcagcaaaataacacatttcaaacttaaaggacaccaaaagcaaaaccaaaagcccaaaaccccactaatgttgggaagcaggaacatctttaattacctggttatataatcgcatccaagatagttaactcctaatggatctaggttttattatttataatacaagtataataagaagacctactggctttaaaatgaaaataagtggaattaaatgaaatattgtataacataatgactatagtagataacaatgtattgtattcttgaaaattgttgagagactaggttttaagtgttctcatcataaaaaataagtatatgaagtaacatatattttgagtagctcaatttagccactccacaatgtatacatatttcaaaacatgttgtacataataagtagatacaatttttgtttctcaagaataaataaaaatgttcaacaattttttaaaaaatggaatcaaggcaggacggcagtctttctgttttctagattaatagttataaccttgcttgggtcatagatctctttgaaactatgttggacgtgcaagctctttttctagaaaattacacacaaaaagtcatactaacaatatcattggtttctcagatcctctaaaggatacacatgtaccccatctagagattcctacaccccacgttaagaacctcttttctaaagactccttcctcgtgggctccttcacgagaggcagagggaagggaaggctggtggcctcttcctgcttactctgccctggctccttttgttctttcttgaagagattatttgggaaatgtctgaggctcagtaggcattgccttcaagtcaaatacaaagcattcaggctgtttatttgggttcccaggtactaaaaaggccgctaatatagctaaaatatttttgtttaaagtgttatggtttattatttatttatttaaaatttgtcagagaactttattaaatttaactcctttctttggagcaaaatgtgtaaaatgaataatattatttgcacacacttattgtcagcagagactgaagaaaactatcattccagattgcagtacggcactacaagcccatggcctaattcactgggacaatgctaaagcccctggtgaatttatatccatttcacactctaaaatatcttggagcaaaactttccaatgaatccaagtattaacaaggtctgcagaaaatctcagaaagttttcattttgttttgattttttttttccctcagttagtttagtttattcaccttggaataggaatacacttaaaattattttgctgatatgtcactaccctttcaacttaattccaagcaatgcctctaataagtgttttagtaaattagattaagttgagaaggattacagattctgtaagaacactatgtatgacattgttgactcactcacatatccagagaaaattactgtttatataagtgaaccttaaatttaggattaaaatcgtattttaaacttattttatataactgattcatttcaatgcacaatcccattatctttgaaagctaaacaggcagtttaaaccacattattgtttttaaattaaagtgttgctcaattaaaaactaaagtggaaataaacaatttcccatactagaaattattcctccaggctgggtgctgtggcccatgcctataatcccagcactctgggaggccgaggcaggcggatcacctgaggttgggagttcaagaccagcctgaccaacatggagaaaccctgtctctactaaaaatacaaaattagccgggcgtggtggtgcatgcctgtaatcccagctactcaggaggctgaggaaagagaatcgcttgcacccgggagatggaggttgccgtgagccgagatcacaccactgcaatccagcctgggcagcaagagtgaaactccgtctcaagaaaaaaaaaaaaaaaaagaaacgaaaaaaaaagttattcctccaaatatttctatggagaaaaataaagtgggtaagggtgacattttttcttaaagaaaaataaagaatggtcaaggagctgggaaattataagaaagaggagctactgtttttttgtattaaaatatgaacattcatattctccaaaaatatttacatgatctctctcttcttatagaagaaaaatggagaaggatagaaccaggtgcaagaaagagttctcttcaaaaagccatgggagaatcccattcacaaccaaagaattcgtggccatattattttttatttcagcctgttctttgaaaatgaaaaggcggaatgtagtggaaagcataagcaaaaagctaaaacactttgtggaatttctttgtaacttccttcgtgtgtaaaaacttaagactttaccatgaggacataatccaggcatctgattgtaggcttctcgttacttggggagttaagggattaattttcatacttaagctcatatgatgacaaaactttttcacaactgtctctaaaccaagaagggggatttaagatctctcaacaaatgaccatttcattacattgttccttattccacttagggtggttcaccatcatctctgagtcaacacatctgtgatcagactaaatgagtcttgccttctgttttagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactgtaagtgatgcacctaaaactgctaagcacgtcagtaactgttgctttcaaatatattgtacttcaatcaacaaatatttgtgaacaactactgcatgcaaagaggatgtactagccgtgggagataaaaacaaatataacacatgacttctatcttaggattgattgtaggacagttgatcgtatagagtaccaaggaagtatgttgaaagttttcattttattcagtttcctataaagctctttctacattgaaaattgaagacctggaattatcactgcaatcatttaaagcagcataactgtcataagattttcaagtacatctgccctttgcccttacttgtcaaggatcccctaagagccacttgctctcatgccctgggcttcagtggcatgtctggagctttcctaatactgatgagatatatacccagatttatatgtagaattatatgcacacacaccttctgatgccatagtaactgctgcaaataggttattggaagaagaaaaaaacactgcattctgtattgctaatactgtgaataatattaggggttattctcattgcctttccagcatctaaaggaataatttgatccaaaaatagaaaaggttcagaatgagaaatagccaactcattactcacctgccgtctaaattcttctacccaaataa
